United States Patent
Denis et al.

(10) Patent No.: US 11,938,164 B2
(45) Date of Patent: Mar. 26, 2024

(54) EXOSOME-BASED CANCER ASSAYS

(71) Applicant: TRUSTEES OF BOSTON UNIVERSITY, Boston, MA (US)

(72) Inventors: Gerald V. Denis, Arlington, MA (US); Louis C. Gerstenfeld, Canton, MA (US); Naser Jafari, Boston, MA (US); Tova Meshulam, Boston, MA (US)

(73) Assignee: TRUSTEES OF BOSTON UNIVERSITY

( * ) Notice: Subject to any disclaimer, the term of this patent is extended or adjusted under 35 U.S.C. 154(b) by 0 days.

(21) Appl. No.: 17/714,295

(22) Filed: Apr. 6, 2022

(65) Prior Publication Data

US 2022/0331390 A1    Oct. 20, 2022

Related U.S. Application Data

(60) Provisional application No. 63/277,766, filed on Nov. 10, 2021, provisional application No. 63/171,689, filed on Apr. 7, 2021.

(51) Int. Cl.
| | | |
|---|---|---|
| *A61K 38/00* | (2006.01) | |
| *A61K 38/21* | (2006.01) | |
| *A61K 45/06* | (2006.01) | |
| *A61P 35/00* | (2006.01) | |

(52) U.S. Cl.
CPC .......... *A61K 38/005* (2013.01); *A61K 38/217* (2013.01); *A61K 45/06* (2013.01); *A61P 35/00* (2018.01)

(58) Field of Classification Search
CPC .. C12Q 1/68; C12Q 1/6809; C12Q 2600/112; C12Q 2600/118
See application file for complete search history.

(56) References Cited

U.S. PATENT DOCUMENTS

2018/0104187 A1    4/2018 Liu et al.

FOREIGN PATENT DOCUMENTS

| WO | 2009015357 A1 | 9/2009 | |
|---|---|---|---|
| WO | WO-2010065968 A1 * | 6/2010 | ....... G01N 33/57434 |
| WO | WO-2014071205 A1 * | 5/2014 | .......... A61K 31/436 |
| WO | WO-2016036949 A1 * | 3/2016 | ................ C12Q 1/68 |
| WO | WO-2017194499 A1 * | 11/2017 | ............. C07K 16/18 |
| WO | WO-2021030679 A2 * | 2/2021 | |

OTHER PUBLICATIONS

Santovito et al (Journal of Clinical Endocrinology and Metabolism, 2014, vol. 99, pp. E1681-E1685) (Year: 2014).*
Jafari et al (Science Signaling, 2021, vol. 14, eabj2807, 11 pages) (Year: 2021).*
Bonotto et al (The Breast, 2018, vol. 40, pp. 45-52) (Year: 2018).*
Kawanami et al (Molecular Sciences, 2017, vol. 18, No. 1083, 15 pages) (Year: 2017).*
Cinti et al (Drug Design Development and Therapy, 2017, vol. 11, pp. 2905-2919) (Year: 2017).*
Aghdam et al. "MicroRNAsas diagnostic, prognostic, and therapeutic biomarkers in prostate cancer," Critical Reviews™ inEukaryotic Gene Expression, 29 (2019).
Chen et al. "miR-103/107 promote metastasis of colorectal cancer by targeting the metastasis suppressors DAPK and KLF4," Cancer research, 72 (2012) 3631-3641.
Gao et al. "Tumorderivedexosomal miR-103a-2-5p facilitates esophageal squamous cell carcinoma cellproliferation and migration," Eur. Rev. Med. Pharmacol. Sci, 24 (2020) 6097-6110.
Iyengar et al. "Obesity and cancer mechanisms: Tumor microenvironment and inflammation." J. Clin. Oncol. 34, 4270-4276 (2016).
Kalluri "The biology and function of exosomes in cancer." J. Clin. Invest. 126, 1208-1215 (2016).
Kang et al. "MicroRNA-326 inhibits melanoma progression by targeting KRAS and suppressing the AKT and ERK signalling pathways," Oncology reports, 39 (2018) 401-410.
Kanwal et al. "MicroRNAs in prostate cancer:Functional role as biomarkers," Cancer Letters, 407 (2017) 9-20.
Liang et al. "miR-326 functions as a tumor suppressor in human prostatic carcinoma by targeting Mucin1," Biomedicine & Pharmacotherapy, 108 (2018) 574-583.
Liang et al. "MiR-93-5p enhances growth and angiogenesis capacity of HUVECs by down-regulating EPLIN," Oncotarget, 8 (2017) 107033.
Lin et al. "Exosome-mediated miRNA delivery promotes liver cancer EMT and metastasis,"American journal of translational research, 12 (2020) 1080.
Liu et al. "Regulatory effect of MiR103 on proliferation, EMT and invasion of oral squamous carcinoma cell through SALL4," Eur. Rev. Med. Pharmacol.Sci, 23 (2019) 9931-9938.
Quan et al. "Exosomal secretion of adipose tissue during various physiological states." Pharm. Res. 37, 221-234 (2020).
Son et al. "miR-374a-5p promotes tumor progression by targeting ARRB1 in triplenegative breast cancer," Cancer letters, 454 (2019) 224-233.
Song et al. "Long Noncoding RNA SOX2-OT Knockdown InhibitsProliferation and Metastasis of Prostate Cancer Cells Through Modulating the miR-452-5p/HMGB3 Axis and Inactivating Wnt/β-Catenin Pathway," Cancer biotherapy & radiopharmaceuticals, 35 (2020) 682-695.
Vella "The emerging role of exosomes in epithelial-mesenchymal-transition in cancer." Front. Oncol. 4, 361 (2014).
Watahiki et al. "Plasma miRNAs as biomarkers to identify patients with castration-resistant metastatic prostatecancer," International journal of molecular sciences, 14 (2013) 7757-7770.
Wo et al. "Long noncoding RNASOX2-OT facilitates prostate cancer cell proliferation and migration via miR-369-3p/CFL2 axis," Biochemical and biophysical research communications, 520 (2019) 586-593.

(Continued)

*Primary Examiner* — Karen A. Canella
(74) *Attorney, Agent, or Firm* — NIXON PEABODY LLP; Ronald I. Eisenstein; Nicole D. Kling

(57) ABSTRACT

The technology described herein is directed to methods of treating and diagnosing cancer, e.g., by measuring the expression of certain genes in exosomes.

24 Claims, 45 Drawing Sheets
Specification includes a Sequence Listing.

(56) References Cited

OTHER PUBLICATIONS

Wyatt et al. "Concordance of circulating tumor DNA and matched metastatic tissue biopsyin prostate cancer," JNCI: Journal of the National Cancer Institute, 109 (2017).
Yang et al. "miR-93-5p may be an important oncogene in prostate cancer by bioinformatics analysis," Journal of cellular biochemistry, 120 (2019) 10463-10483.
Bryant et al, Changes in circulating microRNA levels associated with prostate cancer. Br J Cancer., Jan. 12, 2012, vol. 106, No. 4, p. 768-74; entire document.
Huang et al, A novel serum microRNA signature to screen esophageal squamous cell carcinoma. Cancer Med., 2017, vol. 6, No. 1, p. 109-19; entire document.
Jafari et al, Novel plasma exosome biomarkers for prostate cancer progression in co-morbid metabolic disease. bioRxiv Feb. 1, 2022 .478722 (published online Feb. 4, 2022); retrieved from the Internet Jul. 19, 2022, from https://www.biorxiv.org/content/10.1101/2022.02.01.478722v1 .full.pdf); entire document.
Ji et al, miR-374a-5p: A New Target for Diagnosis and Drug Resistance Therapy in Gastric Cancer. Mol Ther Nucleic Acids., Dec. 2019, vol. 18, p. 320-31; entire document.
Liu et al, miR-93-5p Transferred by Exosomes Promotes the Proliferation of Esophageal Cancer Cells via Intercellular Communication by Targeting PTEN. Biomed Environ Sci., 2018, vol. 31, No. 3, p. 171-85; entire document.
Saffari et al. "The Association of miR-let 7b and miR-548 with PTEN in Prostate Cancer." Urology journal 16.3 (2019): 267-273.

\* cited by examiner

| GENE/Protein | ND | T2D | IS | IR | # PSM |
|---|---|---|---|---|---|
| COMP/Tsp5 | 10 | 37 | 11 | 23 | 81 |
| COCA1/Collagen α1 | 135 | 159 | 117 | 103 | 514 |
| FBLN1/Fibulin-1 | 52 | 61 | 41 | 55 | 209 |
| LAMA4/Laminin α4 | 48 | 40 | 34 | 41 | 163 |
| TSP3/Tsp3 | 8 | 14 | 13 | 17 | 52 |

Fig. 3E

| Person ID | Gender/Age/Ethnicity | BMI | Medical condition | Medication at time of Surgery |
|---|---|---|---|---|
| ABM-004 | F/45/ African American | 36.38 | Diabetes mellitus type II, controlled, with no complications. Morbid obesity due to excess calories. Benign essential hypertension, nontoxic, multinodular, palpitations, nocturnal leg cramps, low back pain with sciatica, uterine leiomyoma, mood disorder | Metformin (GLUCOPHAGE) 500 mg tablet, Metoprolol succinate (TOPROL XL) 100 mg 24 hr tablet, Naltrexone-Bupropion (CONTRAVE) 8-90 mg tablet, Levonorgestrel (MIRENA) 20 mcg/24 hr |
| ABM-007 | F/45/ African American | 41.11 | Non-Diabetic, morbid obesity due to excess calories, psychologic factors affecting medical condition, pseudotumor cerebri | Ergocalciferol 50,000 unit capsule, Ferrous gluconate (FERGON) 324 mg tablet, Topiramate (TOPAMAX) 50 mg tablet |

Fig. 13

| Gene Symbol | ND | T2D | IS | IR | Σ# PSMs | # AAs | MW [kDa] | calc. pI |
|---|---|---|---|---|---|---|---|---|
| COMP | 10 | 37 | 11 | 23 | 81 | 757 | 82.8 | 4.60 |
| COCA1 | 135 | 159 | 117 | 103 | 514 | 3063 | 332.9 | 5.53 |
| FBLN1 | 52 | 61 | 41 | 55 | 209 | 703 | 77.2 | 5.22 |
| LAMA4 | 48 | 40 | 34 | 41 | 163 | 1823 | 202.4 | 6.28 |
| TSP3 | 8 | 14 | 13 | 17 | 52 | 956 | 104.1 | 4.65 |
| APOB | 51 | 56 | 38 | 51 | 196 | 4563 | 515.3 | 7.05 |
| TENX | 8 | 13 | 1 | 3 | 25 | 4289 | 464.0 | 5.34 |
| CO4A2 | 3 | 7 | 35 | 34 | 79 | 1712 | 167.4 | 8.66 |
| SVEP1 | 1 | 5 | 1 |  | 7 | 3571 | 389.9 | 5.50 |
| SYMPK | 1 | 4 | 3 | 2 | 10 | 1274 | 141.1 | 6.13 |
| GRP78 | 3 | 5 | 2 | 2 | 12 | 654 | 72.3 | 5.16 |
| VTNC | 3 | 5 | 5 | 6 | 19 | 478 | 54.3 | 5.80 |
| FIBG | 4 | 6 | 2 | 3 | 15 | 453 | 51.5 | 5.62 |
| EDIL3 | 1 | 3 | 1 |  | 5 | 480 | 53.7 | 7.28 |
| MASP2 | 1 | 2 |  | 2 | 5 | 686 | 75.7 | 5.63 |
| TSP4 | 9 | 9 | 10 | 15 | 43 | 961 | 105.8 | 4.68 |
| ACTN1 | 1 | 1 | 1 | 4 | 7 | 892 | 103.0 | 5.41 |
| CO7 | 1 | 1 | 1 | 4 | 7 | 843 | 93.5 | 6.48 |
| C4BPA | 1 | 1 | 1 | 3 | 6 | 597 | 67.0 | 7.30 |
| NOE3 | 1 | 1 |  | 2 | 4 | 478 | 54.9 | 8.15 |
| CO6A3 | 115 | 80 | 88 | 103 | 386 | 3177 | 343.5 | 6.68 |
| BGH3 | 79 | 60 | 107 | 116 | 362 | 683 | 74.6 | 7.71 |
| CO6A2 | 16 | 11 | 11 | 15 | 53 | 1019 | 108.5 | 6.21 |
| LOXL2 | 19 | 15 | 11 | 21 | 66 | 774 | 86.7 | 6.38 |
| NID1 | 16 | 13 | 6 | 8 | 43 | 1247 | 136.3 | 5.29 |
| EMIL1 | 11 | 10 | 4 | 9 | 34 | 1016 | 106.6 | 5.15 |
| CO5 | 4 | 3 | 4 | 6 | 17 | 1676 | 188.2 | 6.52 |
| PLOD1 |  | 2 | 5 | 12 | 19 | 727 | 83.5 | 6.95 |
| SAP | 1 |  | 1 | 6 | 8 | 524 | 58.1 | 5.17 |
| PLOD2 |  |  | 1 | 6 | 7 | 737 | 84.6 | 6.71 |
| COFA1 |  | 2 | 1 | 2 | 5 | 1388 | 141.6 | 5.00 |
| MASP2 | 1 | 2 |  | 2 | 5 | 686 | 75.7 | 5.63 |
| NOE3 | 1 | 1 |  | 2 | 4 | 478 | 54.9 | 8.15 |
| ENPL |  | 1 |  | 2 | 3 | 803 | 92.4 | 4.84 |
| CC138 |  | 2 |  | 1 | 3 | 665 | 76.2 | 8.53 |
| ZN239 |  | 2 |  | 1 | 3 | 458 | 51.6 | 7.64 |
| MPRI |  |  |  | 3 | 3 | 2491 | 274.2 | 5.94 |
| HGF |  | 2 |  |  | 2 | 728 | 83.1 | 7.88 |
| H4 |  | 2 |  |  | 2 | 103 | 11.4 | 11.36 |
| IBP3 |  |  |  | 2 | 2 | 291 | 31.7 | 8.69 |
| RUN3A |  | 1 |  | 1 | 2 | 446 | 49.7 | 5.27 |

Fig. 14

EXOSOME-BASED CANCER ASSAYS

CROSS-REFERENCE TO RELATED APPLICATIONS

This application claims benefit under 35 U.S.C. § 119(e) of U.S. Provisional Application Nos. 63/171,689 filed Apr. 7, 2021 and 63/277,766 filed No. 10, 2021, the contents of which are incorporated herein by reference in their entirety.

GOVERNMENT SUPPORT

This invention was made with government support under Grant Nos. CA222170 and CA243004 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy, created on Apr. 5, 2022, is named 701586-099990US-PT_SL.txt and is 1,110,069 bytes in size.

TECHNICAL FIELD

The technology described herein relates to methods of treating and diagnosing cancer.

BACKGROUND

Cancer patients who also have chronic inflammatory diseases, such as Type 2 diabetes, have a higher risk of metastasis than patients with the same stage and type of cancer who have normal immunometabolism, particularly in breast and prostate cancers. Yet cancer patient metabolism, medications and adipocyte or bone health are typically not considered in evaluating risk for progression or metastasis of these cancers. The >100 million Americans who are diabetic or pre-diabetic at present are insufficiently served by the standard of care in oncology. Clinical decision making could be greatly improved for patients at-risk for cancer progression on account of their metabolic co-morbidities, but this requires novel diagnostic tools and patient treatment paradigms.

SUMMARY

Most cancer biomarkers rely on markers derived from or induced by cancer cells. Remarkably, the system described herein to assess cancer risk relies on signals from non-tumor tissue which are shown to induce dangerous changes in cancer cells.

The inventors have found that small extracellular vesicles called exosomes (about 30-90 nm in diameter) that originate in non-tumor tissue, such as fat or bone, can carry molecular signals that promote more dangerous (pro-metastatic) changes in cancer. These factors are also found in the peripheral blood of cancer patients and can be used to profile to assist clinical decision making about risks for progression and metastasis.

In one aspect of any of the embodiments, described herein is a method comprising: determining the expression of at least one gene selected from the group consisting of: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d; in an exosome obtained from a subject.

In some embodiments of any of the aspects, the expression of at least one gene selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the expression of at least one gene selected from the group consisting of: miR374a-5p, miR-93-5p, miR-28-3p, miR-let-7b-3p, and miR-375; is determined. In some embodiments of any of the aspects, the expression of at least two genes selected from the group consisting of: miR374a-5p, miR-93-5p, miR-28-3p, miR-let-7b-3p, and miR-375; is determined. In some embodiments of any of the aspects, the expression of at least three genes selected from the group consisting of: miR374a-5p, miR-93-5p, miR-28-3p, miR-let-7b-3p, and miR-375; is determined. In some embodiments of any of the aspects, the expression of at least four genes selected from the group consisting of: miR374a-5p, miR-93-5p, miR-28-3p, miR-let-7b-3p, and miR-375; is determined. In some embodiments of any of the aspects, the expression of at least miR374a-5p, miR-93-5p, miR-28-3p, miR-let-7b-3p, and miR-375; is determined. In some embodiments of any of the aspects, the expression of at least miR374a-5p is determined.

In some embodiments of any of the aspects, an increased level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; and/or a decreased level of expression of at least one gene selected from: miR424-5p, miR-326, miR424-5p, miR-27a-3p, miR320b and miR320d; indicates an increased risk of cancer, metastasis, and/or EMT for the subject, wherein the level of expression is relative to the level of expression in a exosome obtained from a healthy non-diabetic subject.

In some embodiments of any of the aspects, the method further comprises a) i) administering a glucose-controlling medication or obesity medication and/or ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference.

In some embodiments of any of the aspects, the method further comprises a) i) administering a glucose-controlling medication or obesity medication and/or ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference; or b) i) not administering a glucose-controlling medication or obesity medication and/or ii) administering CT scans at a frequency of no more than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is not increased relative to a reference; or an expression level of at least one gene selected from: miR424-5p, miR-326, miR424-5p, miR-27a-3p, miR320b and miR320d; which is not decreased relative to a reference.

In one aspect of any of the embodiments, described herein is a method of treating cancer, comprising: a) i) administering a glucose-controlling medication or obesity medication and/or ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference.

In one aspect of any of the embodiments, described herien is a method of treating cancer, comprising: a) i) administering a glucose-controlling medication or obesity medication and/or ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference; orb) i) not administering a glucose-controlling medication or obesity medication and/or ii) administering CT scans at a frequency of no more than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is not increased relative to a reference; or an expression level of at least one gene selected from: miR424-5p, miR-326, miR424-5p, miR-27a-3p, miR320b and miR320d; which is not decreased relative to a reference.

In some embodiments of any of the aspects, the glucose-controlling medication is selected from the group consisting of: metformin, a sulfonylurea, a glinide, a SGLT2 inhibitor, and insulin. In some embodiments of any of the aspects, the glucose-controlling medication is metformin. In some embodiments of any of the aspects, the obesity medication selected from the group consisting of: orlistat, phentermine-topiramate, naltrexone-bupropion, liraglutide, semagludtide, setmelanotide, phentermine, benzphetamine, diethylpropion, and phendimetrazine.

In some embodiments of any of the aspects, the level of expression is the level of mRNA. In some embodiments of any of the aspects, the exosome is 30-90 nm in diameter. In some embodiments of any of the aspects, the exosome originates from a non-tumor tissue. In some embodiments of any of the aspects, the exosome is isolated from a non-tumor tissue and/or cells. In some embodiments of any of the aspects, the non-tumor tissue and/or cells is blood, plasma, adipose tissue, adipocytes, or bone.

In some embodiments of any of the aspects, the method further comprises determining the expression level of at least one gene selected from COMP, TSP5, BRD2, BRD3, miR103a, and SOX2-OT in tumor tissue obtained from the subject.

In some embodiments of any of the aspects, the cancer is an epithelial cancer. In some embodiments of any of the aspects, the cancer is an epithelial adenocarcinoma. In some embodiments of any of the aspects, the cancer is esophageal cancer, pancreatic cancer, cervical cancer, colorectal cancer, gastric cancer, lung cancer, uterine caner, renal cancer, breast cancer, or prostate cancer. In some embodiments of any of the aspects, the cancer is breast and/or prostate cancer.

In some embodiments of any of the aspects, the subject is diabetic, overweight, and/or obese. In some embodiments of any of the aspects, the subject is identified as diabetic when they are determined to have HbA1c of 6.5% or greater, or by fasting glucose or fasting insulin.

In one aspect of any of the embodiments, described herein is a method of treating cancer in a subject in need thereof, the method comprising administering to the subject exosomes which are: from a non-diabetic and/or non-obese donor; and/or determined to have an level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or a level of expression of at least one gene selected from: miR424-5p, miR-326, miR424-5p, miR-27a-3p, miR320b and miR320d; which is not increased, wherein the level of expression is relative to the level of expression in a exosome obtained from a healthy non-diabetic subject.

In one aspect of any of the embodiments, described herein is a method of treating cancer in a subject in need thereof, the method comprising administering to the subject: an inhibitor of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or an agonist of at least one gene selected from: miR424-5p, miR-326, miR424-5p, miR-27a-3p, miR320b and miR320d.

In some embodiments of any of the aspects, the subject is one determined to have: an increased level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d.

In some embodiments of any of the aspects, the method results in EMT being reduced in the subject. In some embodiments of any of the aspects, the subject is further administered a BET inhibitor or PROTAC degrader.

BRIEF DESCRIPTION OF THE DRAWINGS

(FIG. 1A) MCF-7 cells were co-cultured for 5 days with insulin sensitive (IS) adipocytes that were differentiated from human primary pre-adipocytes, or ex vivo-induced insulin resistant (IR) adipocytes from the same source, and compared to control without coculture (con). Expression of selected EMT genes was analyzed by commercial PCR array (n=3). (FIG. 1B) Ingenuity pathway analysis of differentially expressed MCF-7 genes in (FIG. 1A) revealed that, compared to IS adipocytes, co-culture with IR adipocytes strongly induced tumor cell signatures associated with aggressiveness. (FIG. 1C) Fluorimetric glucose uptake assay confirmed that 24 h treatment of primary adipocytes with recombinant human TNFα (250 pM; +) vs untreated control (−) converted IS to IR adipocytes, unable to transport glucose in response to 10 nM insulin. (FIG. 1D) Extracellular vesicles (EV) purified from adipocyte conditioned media induced transcription of EMT genes SNAI1 and SNAI2, but not EVs purified from conditioned media of 5 matched, undifferentiated pre-adipocytes (pre). Fold-change of selected genes Snail (SNAI1) and Slug (SNAI2) was measured by RT-PCR relative to β-actin (ACTB) with qPCR TaqMan probes (n=3; *, P<0.05; ***, P<0.005; ns, not significant).

(FIG. 2A) MCF-7 cells were treated with EVs for 5 days and Ingenuity pathway analysis was performed on EMT gene expression array data (n=3). (FIG. 2B) Compared to control or ND adipocytes, EVs from T2D adipocytes increased expression of N-cadherin and decreased expression of E-cadherin in MCF-7 cells, as analyzed by immunofluorescence with DAPI counterstain. Bar, 10 μm (FIG. 2C) Similarly, EVs from T2D patient adipocytes upregulated pathways associated with cancer stem cell formation (n=3). (FIG. 2D) Individual EMT genes from (FIG. 2A) were validated with PCR TaqMan probes. (FIG. 2E) Individual CSC genes from (FIG. 2C) were validated with PCR TaqMan probes. (FIG. 2F) Quantitation of FIG. 2B, showing downregulation of E-cadherin and upregulation of N-cadherin by T2D adipocyte EVs, compared to ND and controls. (n=3; *, P<0.05; , P<0.01; *, P<0.005; ns, not significant).

FIGS. 3A-3F demonstrate that EVs from adipocytes of T2D patients induce morphological, transcriptional and migration phenotypes characteristic of EMT in human breast cancer cells, compared to EVs from adipocytes of ND patients. (FIG. 3A) Treatment for 5 days of three human breast cancer cell lines (MCF-7, T47D, MDA-MB-231) with EVs from adipocytes of T2D patients compared to ND patients or to untreated control (con) altered morphology by light microscopy. Bar, 30 μm. (FIG. 3B) increased cellular perimeter compared to EVs from adipocytes of ND patients and untreated controls, decreased cellular circularity, and increased cellular elongation, a parameter which is converse to circularity. Morphological analysis was conducted using ImageJ. (FIG. 3C) EVs from T2D adipocytes increased migration of MDA-MB-231 breast cancer cells in a 6-h transwell assay. Cells that reached the distal side of the 0.8-μm pore membrane were visualized by crystal violet stain and microscopy. (FIG. 3D) Quantitation of FIG. 3C. (FIG. 3E) Unbiased proteomic analysis of human adipocyte EVs by LC-MS/MS. Σ# PSM (number of Peptide-Spectrum Matches) reports the sum of occurrences of unique peptides for each protein. (FIG. 3F) Knockdown of BRD2 and BRD4 ablated the ability of EVs from either T2D or ND adipocytes to upregulate SNAI and SNAI2 in MCF-7 cells, but not knockdown of BRD3. Gene expression is relative to (β-actin and compared to scrambled siRNA control (scr) (n=3; *, P<0.05; , P<0.01; *, P<0.001).

(FIG. 4A) RT-PCR confirmed increased transcript and Elispot confirmed increased protein compared to EV marker CD63. (FIG. 4B) Upon addition to MCF-7 cells, TSP5 EVs induced EMT genes ZEB1 and SNAI2 compared to control EVs from adipocytes that had been transduced with empty vector lentivirus. Induction of ZEB1 and SNAI2 by human recombinant transforming growth factor (TGF)-β is shown as a positive control. (FIG. 4C) Similar to FIG. 2, synthetic cationic vesicles loaded with ecombinant human TSP5 were added to MCF-7 cells for 5 days and EMT induction as measured by increased vimentin expression was measured by IHC. Anti-Tsp5 antibody was used to confirm delivery of protein by the synthetic vesicle system. As a control for loading and delivery, fluorescently labeled ovalbumin was also incorporated into the vesicles. Bar, 10 μm (FIG. 4D) Heatmap of genes induced by TSP5-loaded vesicles confirms induction of EMT and MMP genes. (FIG. 4E) Ingenuity analysis of TSP5 treatment confirms upregulation of invasion and migration pathways and downregulation of cell death pathways.

(FIG. 6A) MCF-7 cells treated with EVs purified from adipocyte conditioned media induce transcriptional upregulation of an individual mesenchymal marker gene (NOTCH1), decrease of an epithelial marker gene (CDH1) or no change of control genes (STAT3 and ERBB3) by RT-PCR of mRNA using qPCR TaqMan probes. (con, media control EVs; IS, insulin sensitive adipocyte EVs; IR, insulin resistant adipocyte EVs) (n=3; *, P<0.05; ***, P<0.005; ns, not significant) (FIG. 6B) Ingenuity pathway analysis of MCF-7 genes from FIG. 1A co-culture, comparing IS to IR adipocytes, arranged according to Z-score for upregulation in IR. (FIG. 6C) NanoSight size fractionation of adipocyte-origin exosomes. Total exosomes were purified from conditioned media of human primary adipocyte (ABM-007) cultures, resuspended in phosphate buffered saline pH 7.4 without divalent cations and then analyzed by NanoSight to determine concentration and particle sizes. The major population of extracellular vesicles from insulin sensitive and insulin resistant adipocytes had similar diameter of 40-60 nm.

(FIG. 7A) Full array results of EMT gene panel. (FIG. 7B) Full array results of CSC gene panel. Genes that are shared between the two panels are identified by arrows in matching color. Note the rank order of the shared genes is conserved between the two arrays. Heat maps shown for triplicate samples. (FIG. 7C) NanoSight size characterization of primary adipocyte-origin exosomes. Exosomes were purified from conditioned media of human primary adipocyte (ND, ABM-007) and (T2D, ABM-004) cultures, resuspended in PBS pH 7.4 without divalent cations and then analyzed by NanoSight to determine concentration and particle sizes. The major population of extracellular vesicles from ND and T2D adipocytes had similar diameter of 50-150 nm.

(FIG. 9A) 4T1 cells were treated for 3 days with EVs from IS or IR adipocytes, vs. media control EVs, then cells were fixed for immunohistochemistry. Vimentin and E-cadherin, as mesenchymal or epithelial markers respectively, were visualized by fluorophore-conjugated primary anti-mouse antibodies, with phalloidin stain for cytoskeletal structure and DAPI counterstain for DNA. Bar, 10 µm. (FIG. 9B) RT-PCR validation of two selected EMT genes, induced by EVs. (FIG. 9C) Transwell migration assay with 4T1 cells exposed to IS vs IR EVs, or IR treated with 50 nM MZ-1 (25) to inhibit BRD4 and block migration (18,24). (FIG. 9D) Quantitation of B. (n=3; ***, P<0.005).

(FIG. 10A) V5-tag recombinant TSP5 protein (COMP) was overexpressed in MDA-MB-231 cells and IF was performed after 5 days to detect TSP5 (FIG. 10A), and changes in expression of E-cadherin (FIG. 10A) or Vimentin (FIG. 10B). Cells were counterstained with phalloidin and DAPI. Quantitation of IF visualization is shown by mean staining intensity (pixels/µm). Bar, 10 µm. (n=3; *, P<0.05; , P<0.01; *, P<0.005)

(FIG. 12A) Tsp5 mRNA from Tsp5 knockdown adipocytes is compared by qPCR to control adipocytes. (FIG. 12B) Elispot of exosomes purified from scrambled control adipocytes compared to elispot of exosomes purified from Tsp5 knockdown adipocytes, with Cd63 as an exosome marker vs. Tsp5. (FIG. 12C) Quantitation of FIG. 12B. (FIG. 12D) Negative control experiment shows that if exosomes (EV) are depleted of Tsp5 through knockdown of the gene in the source adipocytes, Zeb1 is no longer induced in 4T1 cells. Comparison is to exosomes purified from control knockdown adipocytes (scr), and non-conditioned media exosomes as reference (media). TGF-β is shown as a positive control for induction of Zeb1. A parallel experiment with commercially available, conditioned media that had been depleted of exosomes before 4T1 cell culture caused cell stress in the assay (results not shown), thus this type of experiment was not suitable as an additional negative control. (n=3; *, P<0.05; **, P<0.01) (scr, scrambled shRNA control; TGF-β, transforming growth factor-β).

FIG. 13 depicts a table of clinical information of donors of primary, subcutaneous pre-adipocytes.

FIG. 14 depicts a table of Proteomics analysis of total exosomes purified from adipocyte-conditioned media. Insulin sensitive adipocytes are from a non-diabetic person, converted to insulin resistant ex vivo after treatment with TNF-α. Proteins are ranked based on the PSM difference between ND and T2D. ND, non-diabetic; T2D, Type 2 diabetic; IS, insulin sensitive; IR, insulin resistant; PSMs (number of Peptide-Spectrum Matches), total number of occurrences of unique peptides for each protein; AAs, the number of amino acids in the protein; MW, molecular weight of the protein in kDa; Calc. pI, isoelectric point of each protein.

(FIG. 15A) Plasma exosomes from four, independent T2D subjects (▲) increased SNAI1 mRNA expression after normalizing to ACTB of the respective sample and compared to the control cells that were treated with growth media exosomes. (●). Exosomes from four, independent ND subjects (■) did not increase SNAI1 mRNA expression relative to ACTB control. TGF-β (TGFB, 5 ng/mL) was used as a positive control (▼) for induction of pro-EMT gene transcription or repression of pro-MET gene transcription. (FIG. 15B) Plasma exosomes from T2D subjects did not induce CDH1 expression. ND plasma exosomes increased CDH1 mRNA expression. Data in FIGS. 15A and 15B were obtained from four biological replicates of ND and T2D, and each biological replicate was conducted in three technical replicates, that are averaged in the graph. Data were analyzed by two-way ANOVA with statistical significance presented as: *, P=0.0244; and ****, P<0.0001; ns, not significant. (FIG. 15C) Expression of selected EMT genes were analyzed by commercial PCR array. Relative expression of significantly differentially expressed genes in three independent, T2D exosome-treated samples was compared to three independent, ND exosome-treated samples. Equal numbers of exosomes ($10^9$) from each sample were used. The heatmap of the PCR array result was calculated by hierarchical clustering. Scale bar (right) shows fold change. (ND, non-diabetic; T2D, Type 2 diabetic; TGFB, TGF-β positive control).

(FIG. 16A) Ingenuity pathway analysis (IPA) of disease and function based on FIG. 15C. IPA prediction shows that plasma exosomes from independent T2D subjects strongly induced tumor cell signatures associated with cancer aggressiveness compared to plasma exosomes from independent ND subjects. (FIG. 16B) Morphology of DU145 cells treated with equal number of plasma exosomes ND and T2D ($10^9$) compared to the control cells treated with growth media (RPMI-1640+10% FBS) exosomes. One representative field of view is shown, out of 25 images collected for each of the three experimental conditions with three replicates. Scale bar, 30 µm. (FIG. 16C) Quantification of cell morphology, including cellular perimeter, circularity and elongation (a parameter that is converse to circularity) measured in images from FIG. 16B. Expression in each experimental was compared to control (n=25 cells each from N=3 independent experiments). Data were analyzed by one-way ANOVA, with statistical significance presented as: ****, $p<0.0001$. (ND, non-diabetic; T2D, Type 2 diabetic; Control, media-only exosomes).

(FIG. 17C) Hierarchical clustering of genes involved in inflammation and cancer immune crosstalk, analyzed by commercial PCR array. DU145 cells were treated with plasma exosomes from three T2D subjects or three ND subjects. Equal numbers of exosomes ($10^9$) from each sample were used. The heatmap of the PCR array result was calculated by hierarchical clustering. Scale bar (right) shows fold change. (ND, non-diabetic; T2D, Type 2 diabetic; Control, media-only exosomes; IFNgamma, interferon-γ).

(FIG. 18A) Heatmap of differentially expressed microRNAs in plasma exosomes of two T2D subjects compared to plasma exosomes of ND subjects. Total RNA was isolated from plasma exosomes of T2D and ND subjects, and miRNAs were profiled by a commercial PCR array. DU145 cells were transfected with individual miRNAs from (FIG. 18A) (25 nM), selected based on their functional significance for EMT and immune exhaustion. The mRNA expression of SNAI1 (FIG. 18B), CD274 (FIG. 18C) and CDH1 (FIG. 18D) was tested and expression relative to β-actin (ACTB) is shown. Scale bar (FIG. 18A, right) shows fold change. Data were analyzed by one-way ANOVA with statistical significance presented as: *, $P<0.05$; *, $P<0.001$; **, $P<0.0001$; ns, not significant. (Control, media only exosomes; TGFB, TGF-β positive control at 5 ng/mL for SNAI1 induction; IFNgamma, interferon-γ positive control at 5 ng/mL for CD274 induction).

(FIG. 19A) Expression of SNAI1 and CD274 genes in DU145 cells measured by RT-PCR of cellular RNA after exosome treatment. T2D exosomes (109; T2D Exo) were compared to media only control exosomes (Control), or T2D Exo+JQ1 or MZ1. (JQ1 is a pan-BET inhibitor (400 nM) and MZ-1 is a BRD4-selective degrader (50 nM)). (FIG. 19B) Expression of PD-L1 was measured by flow cytometry after treatments. One million events were analyzed by Flow-Jo and presented as overlaid histograms (control, red trace; experimental, black trace). (FIG. 19C) Flow cytometry data of FIG. 19B were quantified with PD-L1 as percent of parent population. The experiment was conducted in triplicate with differences between means represented as bar graphs. Data were analyzed by two-way ANOVA with statistical significance presented as: ****, $P<0.0001$ (TGFB, TGF-β positive control at 5 ng/mL for SNAI1 induction; IFNgamma, interferon-γ positive control at 5 ng/mL for CD274 induction).

(FIG. 23A) Exosome RNA was stained with RNASelect (Exo RNA; Alexa Fluor™-488), then exosomes were washed and added to DU145 cells. Cells were imaged at 0, 4, 8, 16 and 24-hour time points. Filamentous actin (F-actin) was stained with Alexa Fluor™ Phalloidin probe 568 nm (Phalloidin) and DNA was visualized by DAPI counterstain (DAPI). One representative field of view is shown, out of 25 images collected for each of the three experimental conditions with three replicates. Scale bar, 10 µm. The mean intensity of stained RNA (Alexa Fluor™-488) was quantified using ImageJ (FIG. 23B).

(FIG. 24A) Plot of PC2 vs. PC1, computed across all genes in the DU145 samples. Plasma exosomes of T2D subjects had unique and different PCA values, while plasma exosomes of ND subjects had PCA values that were close to the media-only control values. (FIG. 24B) RNA seq expression of miR103a, SOX2-OT, Cav1 and SNAI1 in DU145 cells treated with ND and T2D exosomes. The variance stabilizing transformed (VST) expression values for each gene were z-score-normalized to a mean of zero and standard deviation of 1 within all replicates of all samples. The Y axis shows the VST values. (FIG. 24C) Differential expression of genes unregulated in DU145 cells treated with T2D exosomes (right) vs. those of ND exosomes (left). Significantly differentially expressed genes were identified using a p value cutoff of 0.05 and a fold change cutoff of 1 (dotted lines). Figure was generated using EnhancedVolcano package.

DETAILED DESCRIPTION

Figures 1A, 1B, 1C, 1D:
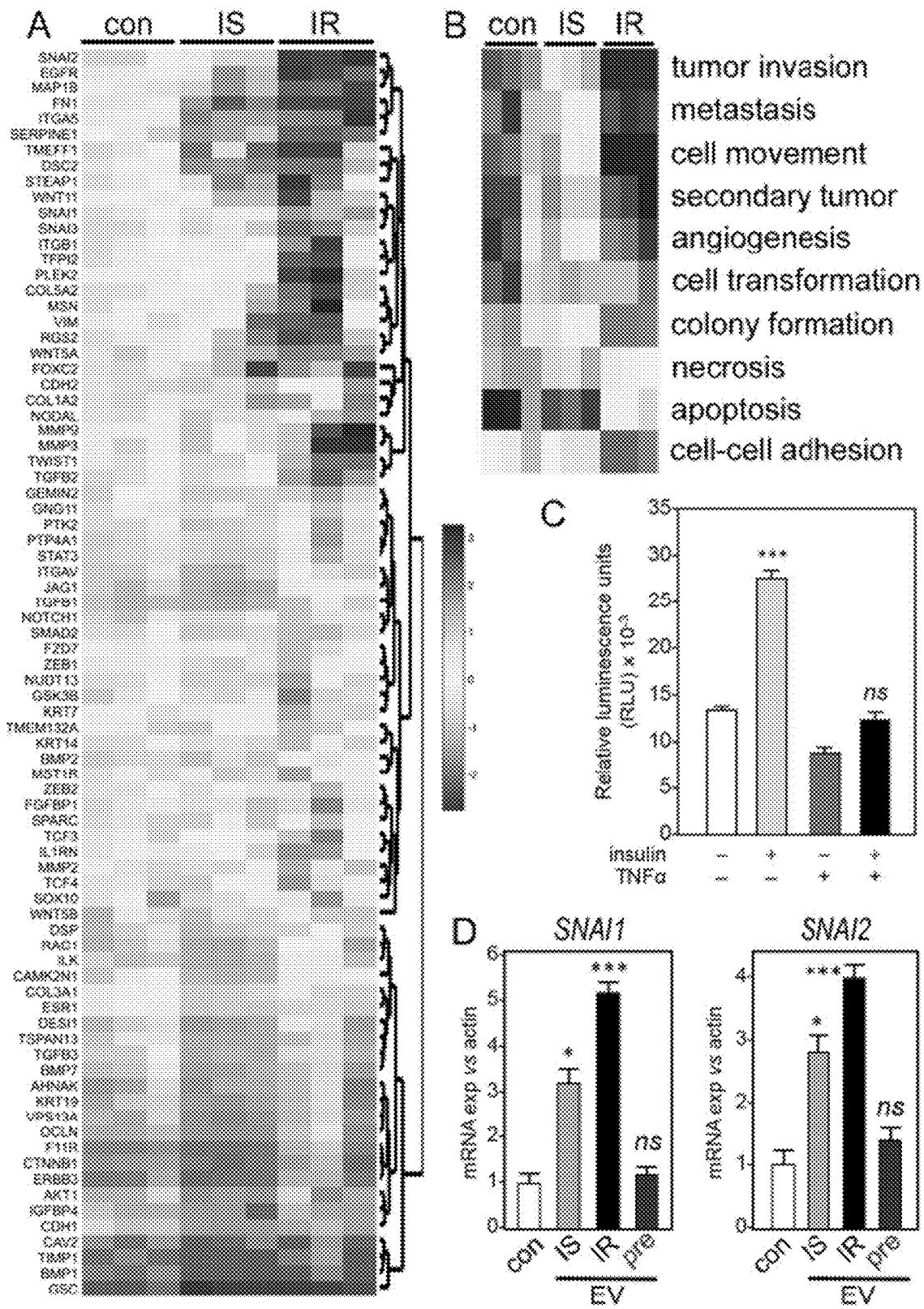
FIGS. 1A-1D demonstrate that human adipocytes induce transcription of EMT genes in co-cultured ER+ human breast cancer cell model.

As described herein, the inventors have found that exosomes with specific gene expression patterns influence cancer cell behavior, promoting EMT and metastasis. The inventors demonstrate that this gene expression profile can be used as a biomarker to detect patients with cancer, high risk cancer, or who are at high risk of cancer, EMT, and/or metastasis. The inventors also describe methods of treatment, including administering exosomes without the pro-metastasis gene expression profile, or by administering treatments that counteract the crosstalk of the cancer promoting exosomes and cancer cells.

Accordingly, in one aspect of any of the embodiments, described herein is a method comprising determining the expression of at least one gene selected from the group consisting of: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d; in an exosome obtained from a subject.

As used herein, "exosome" refers to a nano- or micro-sized membrane vesicle vesicle comprising a membrane that encloses an internal space, and which is secreted or shed from a cell, e.g., by direct plasma membrane budding or by fusion of the late endosome with the plasma membrane. Exosomes are enclosed by a lipid bilayer and range in size from approximately 10 nm to 1000 nm in diameter. Without wishing to be bound by theory, it is believed that materials endocytosed by a cell or other cellular components may be sorted into endosomal compartments, forming intraluminal vesicles (multivesicular endosomes or multivesicular bodies (MVBs)). The vesicles may then be released into the extracellular environment upon the fusion of MVBs with the plasma membrane.

In some embodiments of any of the aspects, the exosome is from 5-200 nm in diameter. In some embodiments of any of the aspects, the exosome is from 10-150 nm in diameter. In some embodiments of any of the aspects, the exosome is from 20-110 nm in diameter. In some embodiments of any of the aspects, the exosome is from 30-90 nm in diameter.

In some embodiments of any of the aspects, the method further comprises a first step of size selection or purification of exosomes from a sample obtained from the subject, e.g., to provide a sample comprising only exosomes of 5-200 nm diameter size, 10-150 nm diameter size, 20-110 nm diameter size, or 30-90 nm diameter size. In some embodiments of any of the aspects, the sample does not comprise cells. In some embodiments of any of the aspects, the sample does not comprise cell-free DNA.

In some embodiments of any of the aspects, the exosome originated from a non-tumor tissue and/or cells. In some embodiments of any of the aspects, the exosome is isolated, purified, or size-selected from a non-tumor tissue and/or cells. In some embodiments of any of the aspects, the exosome is isolated, purified, or size-selected from a sample comprising non-tumor tissue and/or cells. In some embodiments of any of the aspects, the exosome is isolated, purified, or size-selected from a sample taken from a non-tumor tissue. In some embodiments of any of the aspects, the non-tumor tissue and/or cells is blood, plasma, adipose tissue, adipocytes, or bone. In some embodiments of any of the aspects, sample is or comprises blood, plasma, adipose tissue, adipocytes, or bone. In some embodiments of any of the aspects, the non-tumor tissue and/or cells is blood or plasma. In some embodiments of any of the aspects, sample is or comprises blood or plasma. In some embodiments of any of the aspects, the non-tumor tissue and/or cells is plasma. In some embodiments of any of the aspects, sample is or comprises plasma.

In some embodiments of any of the aspects, the method comprises determining the expression of at least two genes selected from the group consisting of: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d. In some embodiments of any of the aspects, the method comprises determining the expression of at least three genes selected from the group consisting of: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d. In some embodiments of any of the aspects, the method comprises determining the expression of at least four genes selected from the group consisting of: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d. In some embodiments of any of the aspects, the method comprises determining the expression of at least five genes selected from the group consisting of: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d. In some embodiments of any of the aspects, the method comprises determining the expression of at least five genes selected from the group consisting of: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d.

In some embodiments of any of the aspects, the method comprises determining the expression of at least one gene selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least two genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least three genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least four genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least five genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least six genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least seven genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least eight genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least nine genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least ten genes selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined. In some embodiments of any of the aspects, the method comprises determining the expression of at least miR374a-5p, miR-93-5p, miR-28-3p, miR-let-7b-3p, miR-375, miR-424-5p, miR-326, miR424-5p, miR-27a-3p, miR320b, and miR320d; is determined.

In some embodiments of any of the aspects, the method comprises determining the expression of at least one gene selected from the group consisting of: miR374a-5p, miR-93-5p, miR-28-3p, miR-let-7b-3p, and miR-375; is determined. In some embodiments of any of the aspects, the method comprises determining the expression of at least two genes selected from the group consisting of: miR374a-5p, miR-93-5p, miR-28-3p, miR-let-7b-3p, and miR-375; is determined. In some embodiments of any of the aspects, the method comprises determining the expression of at least three genes selected from the group consisting of: miR374a-5p, miR-93-5p, miR-28-3p, miR-let-7b-3p, and miR-375; is determined. In some embodiments of any of the aspects, the method comprises determining the expression of at least four genes selected from the group consisting of: miR374a-5p, miR-93-5p, miR-28-3p, miR-let-7b-3p, and miR-375; is determined. In some embodiments of any of the aspects, the method comprises determining the expression of at least miR374a-5p, miR-93-5p, miR-28-3p, miR-let-7b-3p, and miR-375; is determined.

For example, in some embodiments of any of the aspects, the method comprises determining the expression of any of the following combinations of genes:
a) miR374a-5p, miR-93-5p, miR-28-3p, miR-let-7b-3p, and miR-375;
b) miR-93-5p, miR-28-3p, miR-let-7b-3p, and miR-375;
c) miR374a-5p, miR-28-3p, miR-let-7b-3p, and miR-375;
d) miR374a-5p, miR-93-5p, miR-let-7b-3p, and miR-375;
e) miR374a-5p, miR-93-5p, miR-28-3p, and miR-375;
f) miR374a-5p, miR-93-5p, miR-28-3p, and miR-let-7b-3p;
g) miR-28-3p, miR-let-7b-3p, and miR-375;

h) miR-93-5p, miR-let-7b-3p, and miR-375;
i) miR-93-5p, miR-28-3p, and miR-375;
j) miR-93-5p, miR-28-3p, and miR-let-7b-3p;
k) miR374a-5p, miR-let-7b-3p, and miR-375;
l) miR374a-5p, miR-28-3p, and miR-375;
m) miR374a-5p, miR-28-3p, and miR-let-7b-3p;
n) miR374a-5p, miR-93-5p, and miR-375;
o) miR374a-5p, miR-93-5p, and miR-let-7b-3p;
p) miR374a-5p, miR-93-5p, and miR-28-3p;
q) miR374a-5p, and miR-93-5p;
r) miR374a-5p, and miR-28-3p;
s) miR374a-5p, and miR-let-7b-3p;
t) miR374a-5p, and miR-375;
u) miR-93-5p and miR-28-3p;
v) miR-93-5p and miR-let-7b-3p;
w) miR-93-5p and miR-375;
x) miR-28-3p and miR-let-7b-3p;
y) miR-28-3p and miR-375; or
z) miR-let-7b-3p, and miR-375.

In some embodiments of any of the aspects, the method comprises determining the expression of at least miR374a-5p. In some embodiments of any of the aspects, the method comprises determining the expression of at least miR374a-5p and at least one of miR-93-5p, miR-28-3p, miR-let-7b-3p, and miR-375.

The sequences for miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK, miR424-5p, miR-326, miR424-5p, miR-27a-3p, miR320b and miR320d are known in the art. For example, the human sequences for the foregoing genes are available in the NCBI and/or miRBase databases. Exemplary sequences for the foregoing genes are provided in Table 3 below. In some embodiments of any of the aspects, miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK, miR424-5p, miR-326, miR424-5p, miR-27a-3p, miR320b or miR320d are a gene or gene expression product having a sequence with at least 80%, at least 85%, at least 90%, at least 95%, at least 98%, or greater sequence identity to a sequence provided in Table 3. In some embodiments of any of the aspects, miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK, miR424-5p, miR-326, miR424-5p, miR-27a-3p, miR320b or miR320d are a gene or gene expression product having a sequence with at least 80%, at least 85%, at least 90%, at least 95%, at least 98%, or greater sequence identity to a sequence provided in Table 3 and retaining the same activity as the reference sequence provided in Table 3. In some embodiments of any of the aspects, miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK, miR424-5p, miR-326, miR424-5p, miR-27a-3p, miR320b or miR320d are a gene or gene expression product having the sequence of a sequence provided in Table 3.

TABLE 3

| As used herein | Human gene designation and/or full name | Type | Sequence or NCBI Gene ID | Accession Number | SEQ ID NO: |
|---|---|---|---|---|---|
| miR374a-5p | hsa-mir-374a | RNA | | MI0000782 | 1 |
| miR-93-5p | hsa-miR-93-5p | RNA | | MIMAT0000093 | 2 |
| miR-28-3p | hsa-miR-28-3p | RNA | | MIMAT0004502 | 3 |
| miR-let-7b-3p | hsa-let-7b | RNA | | MI0000063 | 4 |
| miR-375 | hsa-mir-375 | RNA | | MI0000783 | 5 |
| miR424-5p | hsa-miR-424-5p | RNA | | MIMAT0001341 | 6 |
| miR-326 | hsa-mir-326 | RNA | | MI0000808 | 7 |
| miR-27a-3p | hsa-miR-27a-3p | RNA | | MIMAT0000084 | 8 |
| miR320b | hsa-miR-320b | RNA | This has a mature sequence of AAAAGCUGGGUUGAGAGGGCAA (SEQ ID NO: 9) and is encoded by the pre miR-320b-1 and miR-320b-2. | MIMAT0005792 | 9 |
| miR320c | hsa-miR-320c | RNA | This has a mature sequence of AAAAGCUGGGUUGAGAGGGU (SEQ ID NO: 10) and is encoded by the pre mir-320c-1 and mir-320c-2 | MIMAT0005793 | 10 |
| miR320d | hsa-miR-320d | RNA | This has a mature sequence of AAAAGCUGGGUUGAGAGGA(SEQ ID NO: 11) and is encoded by the pre miR-320d-1 and miR-320d-2. | MIMAT0006764 | 11 |
| TSP5 | COMP cartilage oligomeric matrix protein | mRNA | ID: 1311 | NM_000095.3 | 12 |
| TSP5 | COMP cartilage oligomeric matrix protein | protein | ID: 1311 | NP_000086.2 | 13 |
| SNAI1 | snail family transcriptional repressor 1 | mRNA | ID: 6615 | NM_005985.4 | 14 |
| SNAI1 | snail family transcriptional repressor 1 | protein | ID: 6615 | NP_005976.2 | 15 |
| TWIST1 | twist family bHLH transcription factor 1 | RNA | ID: 7291 | NR_149001.2 | 16 |
| TWIST1 | twist family bHLH transcription factor 1 | mRNA | ID: 7291 | NM_000474.4 | 17 |

TABLE 3-continued

| As used herein | Human gene designation and/or full name | Type | Sequence or NCBI Gene ID | Accession Number | SEQ ID NO: |
|---|---|---|---|---|---|
| TWIST1 | twist family bHLH transcription factor 1 | protein | ID: 7291 | NP_000465.1 | 18 |
| SNAI2 | snail family transcriptional repressor 2 | mRNA | ID: 6591 | NM_003068.5 | 19 |
| SNAI2 | snail family transcriptional repressor 2 | protein | ID: 6591 | NP_003059.1 | 20 |
| VIM | vimentin | mRNA | ID: 7431 | NM_003380.5 | 21 |
| VIM | vimentin | protein | ID: 7431 | NP_003371.2 | 22 |
| VIM | Vimentin isoform X1 | mRNA | ID: 7431 | XM_006717500.2 | 23 |
| VIM | Vimentin isoform X1 | protein | ID: 7431 | XP_006717563.1 | 24 |
| CDH1 | cadherin 1 | mRNA | ID: 999 | NM_001317184.2 | 25 |
| CDH1 | cadherin 1 | Protein | ID: 999 | NP_001304113.1 | 26 |
| CDH1 | cadherin 1 | mRNA | ID: 999 | NM_001317185.2 | 27 |
| CDH1 | cadherin 1 | Protein | ID: 999 | NP_001304114.1 | 28 |
| CDH1 | cadherin 1 | mRNA | ID: 999 | NM_001317186.2 | 29 |
| CDH1 | cadherin 1 | Protein | ID: 999 | NP_001304115.1 | 30 |
| CDH1 | cadherin 1 | mRNA | ID: 999 | NM_004360.5 | 31 |
| CDH1 | cadherin 1 | protein | ID: 999 | NP_004351.1 | 32 |
| ZEB1, | zinc finger E-box-binding homeobox 1 isoform a | mRNA | ID: 6935 | NM_001128128.3 | 33 |
| ZEB1 | zinc finger E-box-binding homeobox 1 isoform c | Protein | ID:6935 | NP_001121600.1 | 34 |
| ZEB1 | zinc finger E-box-binding homeobox 1 isoform c | mRNA | ID: 6935 | NM_001174093.2 | 35 |
| ZEB1 | zinc finger E-box-binding homeobox 1 isoform d | Protein | ID: 6935 | NP_001167564.1 | 36 |
| ZEB1 | zinc finger E-box-binding homeobox 1 isoform d | mRNA | ID: 6935 | NM_001174094.2 | 37 |
| ZEB1 | zinc finger E-box-binding homeobox 1 isoform e | Protein | ID: 6935 | NP_001167565.1 | 38 |

TABLE 3-continued

| As used herein | Human gene designation and/or full name | Type | Sequence or NCBI Gene ID | Accession Number | SEQ ID NO: |
|---|---|---|---|---|---|
| ZEB1 | zinc finger E-box-binding homeobox 1 isoform e | mRNA | ID: 6935 | NM_001174095.2 | 39 |
| ZEB1 | zinc finger E-box-binding homeobox 1 isoform f | Protein | ID: 6935 | NP_001167566.1 | 40 |
| ZEB1 | zinc finger E-box-binding homeobox 1 isoform f | mRNA | ID: 6935 | NM_001174096.2 | 41 |
| ZEB1 | zinc finger E-box-binding homeobox 1 isoform g | Protein | ID: 6935 | NP_001167567.1 | 42 |
| ZEB1 | zinc finger E-box-binding homeobox 1 isoform g | mRNA | ID: 6935 | NM_001323638.2 | 43 |
| ZEB1 | zinc finger E-box-binding homeobox 1 isoform g | Protein | ID: 6935 | NP_001310567.1 | 44 |
| ZEB1 | zinc finger E-box-binding homeobox 1 isoform g | mRNA | ID: 6935 | NM_001323641.2 | 45 |
| ZEB1 | zinc finger E-box-binding homeobox 1 isoform g | Protein | ID: 6935 | NP_001310570.1 | 46 |
| ZEB1 | zinc finger E-box-binding homeobox 1 isoform g | mRNA | ID: 6935 | NM_001323642.2 | 47 |
| ZEB1 | zinc finger E-box-binding homeobox 1 isoform g | Protein | ID: 6935 | NP_001310571.1 | 48 |
| ZEB1m | zinc finger E-box-binding homeobox 1 isoform g | mRNA | ID: 6935 | NM_001323643.2 | 49 |
| ZEB1 | zinc finger E-box-binding homeobox 1 isoform g | Protein | ID: 6935 | NP_001310572.1 | 50 |
| ZEB1 | zinc finger E-box-binding homeobox 1 isoform g | mRNA | ID: 6935 | NM_001323644.2 | 51 |
| ZEB1 | zinc finger E-box-binding homeobox 1 isoform g | Protein | ID: 6935 | NP_001310573.1 | 52 |

TABLE 3-continued

| As used herein | Human gene designation and/or full name | Type | Sequence or NCBI Gene ID | Accession Number | SEQ ID NO: |
|---|---|---|---|---|---|
| ZEB1 | zinc finger E-box-binding homeobox 1 isoform g | mRNA | ID: 6935 | NM_001323645.2 | 53 |
| ZEB1 | zinc finger E-box-binding homeobox 1 isoform g | Protein | ID: 6935 | NP_001310574.1 | 54 |
| ZEB1 | zinc finger E-box-binding homeobox 1 isoform g | mRNA | ID: 6935 | NM_001323646.2 | 55 |
| ZEB1 | zinc finger E-box-binding homeobox 1 isoform g | Protein | ID: 6935 | NP_001310575.1 | 56 |
| ZEB1 | zinc finger E-box-binding homeobox 1 isoform g | mRNA | ID: 6935 | NM_001323647.2 | 57 |
| ZEB1 | zinc finger E-box-binding homeobox 1 isoform g | Protein | ID: 6935 | NP_001310576.1 | 58 |
| ZEB1 | zinc finger E-box-binding homeobox 1 isoform g | mRNA | ID: 6935 | NM_001323648.2 | 59 |
| ZEB1 | zinc finger E-box-binding homeobox 1 isoform g | Protein | ID: 6935 | NP_001310577.1 | 60 |
| ZEB1 | zinc finger E-box-binding homeobox 1 isoform g | mRNA | ID: 6935 | NM_001323649.2 | 61 |
| ZEB1 | zinc finger E-box-binding homeobox 1 isoform g | protein | ID: 6935 | NP_001310578.1 | 62 |
| ZEB1 | zinc finger E-box-binding homeobox 1 isoform g | mRNA | ID: 6935 | NM_001323650.2 | 63 |
| ZEB1 | zinc finger E-box-binding homeobox 1 isoform g | Protein | ID: 6935 | NP_001310579.1 | 64 |
| ZEB1 | zinc finger E-box-binding homeobox 1 isoform g | mRNA | ID: 6935 | NM_001323651.2 | 65 |
| ZEB1 | zinc finger E-box-binding homeobox 1 isoform g | protein | ID: 6935 | NP_001310580.1 | 66 |

TABLE 3-continued

| As used herein | Gene Human gene designation and/or full name | Exemplary Sequences Type | Sequence or NCBI Gene ID | Accession Number | SEQ ID NO: |
|---|---|---|---|---|---|
| ZEB1 | zinc finger E-box-binding homeobox 1 isoform g | mRNA | ID: 6935 | NM_001323652.2 | 67 |
| ZEB1 | zinc finger E-box-binding homeobox 1 isoform g | protein | ID: 6935 | NP_001310581.1 | 68 |
| ZEB1 | zinc finger E-box-binding homeobox 1 isoform g | mRNA | ID: 6935 | NM_001323653.2 | 69 |
| ZEB1 | zinc finger E-box-binding homeobox 1 isoform g | protein | ID: 6935 | NP_001310582.1 | 70 |
| ZEB1 | zinc finger E-box-binding homeobox 1 isoform g | mRNA | ID: 6935 | NM_001323654.2 | 71 |
| ZEB1 | zinc finger E-box-binding homeobox 1 isoform g | Protein | ID: 6935 | NP_001310583.1 | 72 |
| ZEB1 | zinc finger E-box-binding homeobox 1 isoform g | mRNA | ID: 6935 | NM_001323655.2 | 73 |
| ZEB1 | zinc finger E-box-binding homeobox 1 isoform g | protein | ID: 6935 | NP_001310584.1 | 74 |
| ZEB1 | zinc finger E-box-binding homeobox 1 isoform g | mRNA | ID: 6935 | NM_001323656.2 | 75 |
| ZEB1 | zinc finger E-box-binding homeobox 1 isoform g | Protein | ID: 6935 | NP_001310585.1 | 76 |
| ZEB1 | zinc finger E-box-binding homeobox 1 isoform g | mRNA | ID: 6935 | NM_001323657.2 | 77 |
| ZEB1 | zinc finger E-box-binding homeobox 1 isoform g | Protein | ID: 6935 | NP_001310586.1 | 78 |
| ZEB1 | zinc finger E-box-binding homeobox 1 isoform g | mRNA | ID: 6935 | NM_001323658.2 | 79 |
| ZEB1 | zinc finger E-box-binding homeobox 1 isoform g | protein | ID: 6935 | NP_001310587.1 | 80 |

TABLE 3-continued

| As used herein | Gene Human gene designation and/or full name | Exemplary Sequences | | | SEQ ID NO: |
|---|---|---|---|---|---|
| | | Type | Sequence or NCBI Gene ID | Accession Number | |
| ZEB1 | zinc finger E-box-binding homeobox 1 isoform g | mRNA | ID: 6935 | NM_001323659.2 | 81 |
| ZEB1 | zinc finger E-box-binding homeobox 1 isoform g | Protein | ID: 6935 | NP_001310588.1 | 82 |
| ZEB1 | zinc finger E-box-binding homeobox 1 isoform g | mRNA | ID: 6935 | NM_001323660.2 | 83 |
| ZEB1 | zinc finger E-box-binding homeobox 1 isoform g | protein | ID: 6935 | NP_001310589.1 | 84 |
| ZEB1 | zinc finger E-box-binding homeobox 1 isoform g | mRNA | ID: 6935 | NM_001323661.2 | 85 |
| ZEB1 | zinc finger E-box-binding homeobox 1 isoform g | protein | ID: 6935 | NP_001310590.1 | 86 |
| ZEB1 | zinc finger E-box-binding homeobox 1 isoform g | mRNA | ID: 6935 | NM_001323662.2 | 87 |
| ZEB1 | zinc finger E-box-binding homeobox 1 isoform g | protein | ID: 6935 | NP_001310591.1 | 88 |
| ZEB1 | zinc finger E-box-binding homeobox 1 isoform g | mRNA | ID: 6935 | NM_001323663.2 | 89 |
| ZEB1 | zinc finger E-box-binding homeobox 1 isoform g | protein | ID: 6935 | NP_001310592.1 | 90 |
| ZEB1 | zinc finger E-box-binding homeobox 1 isoform g | mRNA | ID: 6935 | NM_001323664.2 | 91 |
| ZEB1 | zinc finger E-box-binding homeobox 1 isoform g | protein | ID: 6935 | NP_001310593.1 | 92 |
| ZEB1 | zinc finger E-box-binding homeobox 1 isoform g | mRNA | ID: 6935 | NM_001323665.2 | 93 |
| ZEB1 | zinc finger E-box-binding homeobox 1 isoform g | protein | ID: 6935 ID: 6935 | NP_001310594.1 | 94 |

TABLE 3-continued

| As used herein | Gene<br>Human gene designation and/or full name | Exemplary Sequences | | | |
|---|---|---|---|---|---|
| | | Type | Sequence or NCBI Gene ID | Accession Number | SEQ ID NO: |
| ZEB1 | zinc finger E-box-binding homeobox 1 isoform g | mRNA | ID: 6935 | NM_001323666.2 | 95 |
| ZEB1 | zinc finger E-box-binding homeobox 1 isoform g | protein | ID: 6935 | NP_001310595.1 | 96 |
| ZEB1 | zinc finger E-box-binding homeobox 1 isoform g | mRNA | ID: 6935 | NM_001323671.2 | 97 |
| ZEB1 | zinc finger E-box-binding homeobox 1 isoform g | protein | ID: 6935 | NP_001310600.1 | 98 |
| ZEB1 | zinc finger E-box-binding homeobox 1 isoform g | mRNA | ID: 6935 | NM_001323672.2 | 99 |
| ZEB1 | zinc finger E-box-binding homeobox 1 isoform g | protein | ID: 6935 | NP_001310601.1 | 100 |
| ZEB1 | zinc finger E-box-binding homeobox 1 isoform g | mRNA | ID: 6935 | NM_001323673.2 | 101 |
| ZEB1 | zinc finger E-box-binding homeobox 1 isoform g | protein | ID: 6935 | NP_001310602.1 | 102 |
| ZEB1 | zinc finger E-box-binding homeobox 1 isoform h | mRNA | ID: 6935 | NM_001323674.2 | 103 |
| ZEB1 | zinc finger E-box-binding homeobox 1 isoform h | protein | ID: 6935 | NP_001310603.1 | 104 |
| ZEB1 | zinc finger E-box-binding homeobox 1 isoform i | mRNA | ID: 6935 | NM_001323675.2 | 105 |
| ZEB1 | zinc finger E-box-binding homeobox 1 isoform i | protein | ID: 6935 | NP_001310604.1 | 106 |
| ZEB1 | zinc finger E-box-binding homeobox 1 isoform j | mRNA | ID: 6935 | NM_001323676.2 | 107 |
| ZEB1 | zinc finger E-box-binding homeobox 1 isoform j | protein | ID: 6935 | NP_001310605.1 | 108 |

TABLE 3-continued

| As used herein | Gene Human gene designation and/or full name | Exemplary Sequences | | | |
|---|---|---|---|---|---|
| | | Type | Sequence or NCBI Gene ID | Accession Number | SEQ ID NO: |
| ZEB1 | zinc finger E-box-binding homeobox 1 isoform k | mRNA | ID: 6935 | NM_001323677.2 | 109 |
| ZEB1 | zinc finger E-box-binding homeobox 1 isoform k | protein | ID: 6935 | NP_001310606.1 | 110 |
| ZEB1 | zinc finger E-box-binding homeobox 1 isoform 1 | mRNA | ID: 6935 | NM_001323678.2 | 111 |
| ZEB1 | zinc finger E-box-binding homeobox 1 isoform 1 | Protein | ID: 6935 | NP_001310607.1 | 112 |
| ZEB1 | zinc finger E-box-binding homeobox 1 isoform b | mRNA | ID: 6935 | NM_030751.6 | 113 |
| ZEB1 | zinc finger E-box-binding homeobox 1 isoform b | protein | ID: 6935 | NP_110378.3 | 114 |
| ZEB1 | zinc finger E-box-binding homeobox 1 isoform X1 | mRNA | ID: 6935 | XM_006717498.2 | 115 |
| ZEB1 | zinc finger E-box-binding homeobox 1 isoform X1 | protein | ID: 6935 | XP_006717561.1 | 116 |
| ZEB1 | zinc finger E-box-binding homeobox 1 isoform X1 | mRNA | ID: 6935 | XM_017016597.1 | 117 |
| ZEB1 | zinc finger E-box-binding homeobox 1 isoform X1 | Protein | ID: 6935 | XP_016872086.1 | 118 |
| ZEB1 | zinc finger E-box-binding homeobox 1 isoform X1 | mRNA | ID: 6935 | XM_011519643.2 | 119 |
| ZEB1 | zinc finger E-box-binding homeobox 1 isoform X1 | Protein | ID: 6935 | XP_011517945.1 | 120 |
| AHNAK | neuroblast differentiation-associated protein AHNAK isoform 1 | mRNA | ID: 79026 | NM_001346445.2 | 121 |

TABLE 3-continued

| | Gene | | | | |
|---|---|---|---|---|---|
| | Human gene designation | | Exemplary Sequences | | |
| As used herein | and/or full name | Type | Sequence or NCBI Gene ID | Accession Number | SEQ ID NO: |
| AHNAK | neuroblast differentiation-associated protein AHNAK isoform 1 | Protein | ID: 79026 | NP_001333374.1 | 122 |
| AHNAK | neuroblast differentiation-associated protein AHNAK isoform 1 | mRNA | ID: 79026 | NM_001346446.2 | 123 |
| AHNAK | neuroblast differentiation-associated protein AHNAK isoform 1 | Protein | ID: 79026 | NP_001333375.1 | 124 |
| AHNAK | neuroblast differentiation-associated protein AHNAK isoform 1 | mRNA | ID: 79026 | NM_001620.3 | 125 |
| AHNAK | neuroblast differentiation-associated protein AHNAK isoform 1 | Protein | ID: 79026 | NP_001611.1 | 126 |
| AHNAK | neuroblast differentiation-associated protein AHNAK isoform 2 | mRNA | ID: 79026 | NM_024060.4 | 127 |
| AHNAK | neuroblast differentiation-associated protein AHNAK isoform 2 | Protein | ID: 79026 | NP_076965.2 | 128 |
| AHNAK | neuroblast differentiation-associated protein AHNAK isoform X1 | mRNA | ID: 79026 | XM_017018270.1 | 129 |
| AHNAK | neuroblast differentiation-associated protein AHNAK isoform X1 | Protein | ID: 79026 | XP_016873759.1 | 130 |

As described herein, levels of certain genes described herein, e.g., in exosomes, can be increased or decreased in subjects with cancer, subjects with diabetes or obesity, or in subjects at greater risk of EMT and/or metastasis. Accordingly, in one aspect of any of the embodiments, described herein is a method of treating cancer in a subject in need thereof, the method comprising a) administering a glucose-controlling medication or obesity medication and/or b) administering CT scans at a frequency of higher than 1 CT scan every 6 months, to a subject determined to have an increased level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; relative to a reference. In one aspect of any of the embodiments, described herein is a method of treating cancer in a subject in need thereof, the method comprising: a) determining the level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR424-5p, miR-326, miR424-5p, miR-27a-3p, miR320b and miR320d in a sample obtained from a subject; and b) i) administering a glucose-controlling medication or obesity medication and/or ii) administering CT scans at a frequency of higher than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference.

in one aspect of any of the embodiments, described herein is a method of treating cancer in a subject in need thereof, the method comprising a) i) administering a glucose-controlling medication or obesity medication and/or ii) administering CT scans at a frequency of higher than 1 CT scan every 6 months, to a subject determined to have an increased level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; relative to a reference; or b) i) not administering a glucose-controlling medication or obesity medication and/or ii) administering CT scans at a frequency of no more than 1 CT scan every 6 months, to a subject determined not to have an increased level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; relative to a reference. In one aspect of any of the embodiments, described herein is a method of treating cancer in a subject in need thereof, the method comprising: a) determining the level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR424-5p, miR-326, miR424-5p, miR-27a-3p, miR320b and miR320d in a sample obtained from a subject; b) i) administering a glucose-controlling medication or obesity medication and/or ii) administering CT scans at a frequency of higher than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference; and c) i) not administering a glucose-controlling medication or obesity medication and/or ii) administering CT scans at a frequency of no more than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference.

In some embodiments of any of the aspects, the method comprises a) administering a glucose-controlling medication or obesity medication and/or b) administering CT scans at a frequency of higher than 1 CT scan every 6 months, to a subject previously determined to have an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; relative to a reference. In some embodiments of any of the aspects, described herein is a method of treating cancer in a subject in need thereof, the method comprising: a) first determining the level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR424-5p, miR-326, miR424-5p, miR-27a-3p, miR320b and miR320d in a sample obtained from a subject; and b) then i) administering a glucose-controlling medication or obesity medication and/or ii) administering CT scans at a frequency of higher than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference.

In some embodiments of any of the aspects, the method comprises a) i) administering a glucose-controlling medication or obesity medication and/or ii) administering CT scans at a frequency of higher than 1 CT scan every 6 months, to a subject previously determined to have an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; relative to a reference; and b) i) not administering a glucose-controlling medication or obesity medication and/or ii) administering CT scans at a frequency of no more than 1 CT scan every 6 months, to a subject previously determined to not have an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; relative to a reference. In some embodiments of any of the aspects, described herein is a method of treating cancer in a subject in need thereof, the method comprising: a) first determining the level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR424-5p, miR-326, miR424-5p, miR-27a-3p, miR320b and miR320d in a sample obtained from a subject; and then b) i) administering a glucose-controlling medication or obesity medication and/or ii) administering CT scans at a frequency of higher than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference; or c) i) not administering a glucose-controlling medication or obesity medication and/or ii) administering CT scans at a frequency of no more than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference.

In one aspect of any of the embodiments, described herein is a method of treating cancer in a subject in need thereof, the method comprising: a) determining if the subject has an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK that is increased relative to a reference; or an expression level of at least one gene selected from: miR424-5p, miR-326, miR424-5p, miR-27a-3p, miR320b and miR320d; that is decreased relative to a reference; and b) i) administering a glucose-controlling medication or obesity medication and/or ii) administering CT scans at a frequency of higher than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference. In one aspect of any of the embodiments, described herein is a method of treating cancer in a subject in need thereof, the method comprising: a) determining if the subject has an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK that is increased relative to a reference; or an expression level of at least one gene selected from: miR424-5p, miR-326, miR424-5p, miR-27a-3p, miR320b and miR320d; that is decreased relative to a reference; and b) i) administering a glucose-controlling medication or obesity medication and/or ii) administering CT scans at a frequency of higher than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference; or c) i) not administering a glucose-controlling medication or obesity medication and/or ii) administering CT scans at a frequency of no more than 1 CT scan every 6 months, to the subject if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference. In some embodiments of any of the aspects, the step of determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise i) obtaining or having obtained a sample from the subject and ii) performing or having performed an assay on the sample obtained from the subject to determine/measure the level of at least one of the foregoing genes in the subject. In some embodiments of any of the aspects, the step of determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise performing or having performed an assay on a sample obtained from the subject to determine/measure the level of at least one of the foregoing genes in the subject. In some embodiments of any of the aspects, the step of determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise ordering or requesting an assay on a sample obtained from the subject to determine/measure the level of at least one of the foregoing genes in the subject. In some embodiments of any of the aspects, the step of determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise receiving the results of an assay on a sample obtained from the subject to determine/measure the level of at least one of the foregoing genes in the subject. In some embodiments of any of the aspects, the step of determining if the subject has an increased expression level of at least one gene selected from: miR374a-5p, miR-93-5p, miR-28-3p, miR-let-7b-3p, miR- 375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise receiving a report, results, or other means of identifying the subject as a subject with an increased and/or decreased level of expression of at least one of the foregoing genes.

In one aspect of any of the embodiments, described herein is a method of treating cancer in a subject in need thereof, the method comprising: a) determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; and b) instructing or directing that the subject be i) administering a glucose-controlling medication or obesity medication and/or ii) administering CT scans at a frequency of higher than 1 CT scan every 6 months, if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference. In one aspect of any of the embodiments, described herein is a method of treating cancer in a subject in need thereof, the method comprising: a) determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; and b) instructing or directing that the subject be i) administered a glucose-controlling medication or obesity medication and/or ii) administered CT scans at a frequency of higher than 1 CT scan every 6 months, if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference; or c) instructing or directing that the subject be i) not administered a glucose-controlling medication or obesity medication and/or ii) administered CT scans at a frequency of no more than 1 CT scan every 6 months, if the expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK is increased relative to a reference; or if the expression level of at least one gene selected from: miR424-5p, miR-326, miR424-5p, miR-27a-3p, miR320b and miR320d; is decreased relative to a reference. In some embodiments of any of the aspects, the step of determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise i) obtaining or having obtained a sample from the subject and ii) performing or having performed an assay on the sample obtained from the subject to determine/measure the level of at least one of the foregoing genes in the subject. In some embodiments of any of the aspects, the step of determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise performing or having performed an assay on a sample obtained from the subject to determine/measure the level of at least one of the foregoing genes in the subject. In some embodiments of any of the aspects, the step of determining if the subject has an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; can comprise ordering or requesting an assay on a sample obtained from the subject to determine/measure the level of at least one of the foregoing genes in the subject. In some embodiments of any of the aspects, the step of instructing or directing that the subject be administered a particular treatment can comprise providing a report of the assay results. In some embodiments of any of the aspects, the step of instructing or directing that the subject be administered a particular treatment can comprise providing a report of the assay results and/or treatment recommendations in view of the assay results.

In one aspect of any of the embodiments, described herein is a method of determining if a subject has cancer, increased risk of cancer, a high level of EMT or metastasis, or is at increased risk of EMT or metastasis, or is in need of treatment for cancer, EMT, or metastasis, the method comprising: determining the level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR424-5p, miR-326, miR424-5p, miR-27a-3p, miR320b and miR320d in a sample obtained from the subject, wherein an increased expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from: miR424-5p, miR-326, miR424-5p, miR-27a-3p, miR320b and miR320d; relative to a reference indicates the subject has cancer, increased risk of cancer, a high level of EMT or metastasis, or is at increased risk of EMT or metastasis, or is in need of treatment for cancer, EMT, or metastasis.

In some embodiments of any of the aspects, the glucose-controlling medication is metformin, a sulfonylurea (e.g., glyburide, glipizide, or glimepiride), a glinide, a SGLT2 inhibitor (e.g., canagliflozin, dapagliflozin, or empagliflozin), or insulin. In some embodiments of any of the aspects, the glucose-controlling medication is metformin. In some embodiments of any of the aspects, the obesity medication is orlistat, phentermine-topiramate, naltrexone-bupropion, liraglutide, semagludtide, setmelanotide, phentermine, benzphetamine, diethylpropion, or phendimetrazine.

In some embodiments of any of the aspects, administering CT scans at a frequency of higher than 1 CT scan every 6 months comprises administering more than 1 CT scan every 6 months for at least one year. In some embodiments of any of the aspects, administering CT scans at a frequency of higher than 1 CT scan every 6 months comprises administering more than 1 CT scan every 6 months for at least two years. In some embodiments of any of the aspects, administering CT scans at a frequency of higher than 1 CT scan every 6 months comprises administering more than 1 CT scan every 6 months for at least three years.

In some embodiments of any of the aspects, administering CT scans at a frequency of higher than 1 CT scan every 6 months comprises administering at least one CT scan every 4 months for at least one year. In some embodiments of any of the aspects, administering CT scans at a frequency of higher than 1 CT scan every 6 months comprises administering at least one CT scan every 4 months for at least two years. In some embodiments of any of the aspects, administering CT scans at a frequency of higher than 1 CT scan every 6 months comprises administering at least one CT scan every 4 months for at least three years.

In some embodiments of any of the aspects, administering CT scans at a frequency of higher than 1 CT scan every 6 months comprises administering at least one CT scan every 3 months for at least one year. In some embodiments of any of the aspects, administering CT scans at a frequency of higher than 1 CT scan every 6 months comprises administering at least one CT scan every 3 months for at least two years. In some embodiments of any of the aspects, administering CT scans at a frequency of higher than 1 CT scan every 6 months comprises administering at least one CT scan every 3 months for at least three years.

In some embodiments of any of the aspects, administering CT scans at a frequency of no more than 1 CT scan every 6 months comprises administering one CT scan every 6 months for at least one year. In some embodiments of any of the aspects, administering CT scans at a frequency of no more than 1 CT scan every 6 months comprises administering one CT scan every 6 months for at least two years. In some embodiments of any of the aspects, administering CT scans at a frequency of no more than 1 CT scan every 6 months comprises administering one CT scan every 6 months for at least three years.

In some embodiments of any of the aspects, administering CT scans at a frequency of no more than 1 CT scan every 6 months comprises administering one CT scan year for at least one year. In some embodiments of any of the aspects, administering CT scans at a frequency of no more than 1 CT scan every 6 months comprises administering one CT scan every year for at least two years. In some embodiments of any of the aspects, administering CT scans at a frequency of no more than 1 CT scan every 6 months comprises administering one CT scan every year for at least three years.

In some embodiments of any of the aspects, measurement of the level of a target and/or detection of the level or presence of a target, e.g. of an expression product (nucleic acid or polypeptide of one of the genes described herein) or a mutation can comprise a transformation. As used herein, the term "transforming" or "transformation" refers to changing an object or a substance, e.g., biological sample, nucleic acid or protein, into another substance. The transformation can be physical, biological or chemical. Exemplary physical transformation includes, but is not limited to, pre-treatment of a biological sample, e.g., from whole blood to blood serum by differential centrifugation. A biological/chemical transformation can involve the action of at least one enzyme and/or a chemical reagent in a reaction. For example, a DNA sample can be digested into fragments by one or more restriction enzymes, or an exogenous molecule can be attached to a fragmented DNA sample with a ligase. In some embodiments of any of the aspects, a DNA sample can undergo enzymatic replication, e.g., by polymerase chain reaction (PCR).

Transformation, measurement, and/or detection of a target molecule, e.g. a mRNA or polypeptide can comprise contacting a sample obtained from a subject with a reagent (e.g. a detection reagent) which is specific for the target, e.g., a target-specific reagent. In some embodiments of any of the aspects, the target-specific reagent is detectably labeled. In some embodiments of any of the aspects, the target-specific reagent is capable of generating a detectable signal. In some embodiments of any of the aspects, the target-specific reagent generates a detectable signal when the target molecule is present.

Methods to measure gene expression products are known to a skilled artisan. Such methods to measure gene expression products, e.g., protein level, include ELISA (enzyme linked immunosorbent assay), western blot, immunoprecipitation, and immunofluorescence using detection reagents such as an antibody or protein binding agents. Alternatively, a peptide can be detected in a subject by introducing into a subject a labeled anti-peptide antibody and other types of detection agent. For example, the antibody can be labeled with a detectable marker whose presence and location in the subject is detected by standard imaging techniques.

For example, antibodies for the various targets described herein are commercially available and can be used for the purposes of the invention to measure protein expression levels. Alternatively, since the amino acid sequences for the targets described herein are known and publically available at the NCBI website, one of skill in the art can raise their own antibodies against these polypeptides of interest for the purpose of the methods described herein.

The amino acid sequences of the polypeptides described herein have been assigned NCBI accession numbers for different species such as human, mouse and rat.

In some embodiments of any of the aspects, immunohistochemistry ("IHC") and immunocytochemistry ("ICC") techniques can be used. IHC is the application of immunochemistry to tissue sections, whereas ICC is the application of immunochemistry to cells or tissue imprints after they have undergone specific cytological preparations such as, for example, liquid-based preparations. Immunochemistry is a family of techniques based on the use of an antibody, wherein the antibodies are used to specifically target molecules inside or on the surface of cells. The antibody typically contains a marker that will undergo a biochemical reaction, and thereby experience a change of color, upon encountering the targeted molecules. In some instances, signal amplification can be integrated into the particular protocol, wherein a secondary antibody, that includes the marker stain or marker signal, follows the application of a primary specific antibody.

In some embodiments of any of the aspects, the assay can be a Western blot analysis. Alternatively, proteins can be separated by two-dimensional gel electrophoresis systems. Two-dimensional gel electrophoresis is well known in the art and typically involves iso-electric focusing along a first dimension followed by SDS-PAGE electrophoresis along a second dimension. These methods also require a considerable amount of cellular material. The analysis of 2D SDS- PAGE gels can be performed by determining the intensity of protein spots on the gel, or can be performed using immune detection. In other embodiments, protein samples are analyzed by mass spectroscopy.

Immunological tests can be used with the methods and assays described herein and include, for example, competitive and non-competitive assay systems using techniques such as Western blots, radioimmunoassay (RIA), ELISA (enzyme linked immunosorbent assay), "sandwich" immunoassays, immunoprecipitation assays, immunodiffusion assays, agglutination assays, e.g. latex agglutination, complement-fixation assays, immunoradiometric assays, fluorescent immunoassays, e.g. FIA (fluorescence-linked immunoassay), chemiluminescence immunoassays (CLIA), electrochemiluminescence immunoassay (ECLIA, counting immunoassay (CIA), lateral flow tests or immunoassay (LFIA), magnetic immunoassay (MIA), and protein A immunoassays. Methods for performing such assays are known in the art, provided an appropriate antibody reagent is available. In some embodiments of any of the aspects, the immunoassay can be a quantitative or a semi-quantitative immunoassay.

An immunoassay is a biochemical test that measures the concentration of a substance in a biological sample, typically a fluid sample such as blood or serum, using the interaction of an antibody or antibodies to its antigen. The assay takes advantage of the highly specific binding of an antibody with its antigen. For the methods and assays described herein, specific binding of the target polypeptides with respective proteins or protein fragments, or an isolated peptide, or a fusion protein described herein occurs in the immunoassay to form a target protein/peptide complex. The complex is then detected by a variety of methods known in the art. An immunoassay also often involves the use of a detection antibody.

Enzyme-linked immunosorbent assay, also called ELISA, enzyme immunoassay or EIA, is a biochemical technique used mainly in immunology to detect the presence of an antibody or an antigen in a sample. The ELISA has been used as a diagnostic tool in medicine and plant pathology, as well as a quality control check in various industries.

In one embodiment, an ELISA involving at least one antibody with specificity for the particular desired antigen (e.g., any of the targets as described herein) can also be performed. A known amount of sample and/or antigen is immobilized on a solid support (usually a polystyrene micro titer plate). Immobilization can be either non-specific (e.g., by adsorption to the surface) or specific (e.g. where another antibody immobilized on the surface is used to capture antigen or a primary antibody). After the antigen is immobilized, the detection antibody is added, forming a complex with the antigen. The detection antibody can be covalently linked to an enzyme, or can itself be detected by a secondary antibody which is linked to an enzyme through bio-conjugation. Between each step the plate is typically washed with a mild detergent solution to remove any proteins or antibodies that are not specifically bound. After the final wash step the plate is developed by adding an enzymatic substrate to produce a visible signal, which indicates the quantity of antigen in the sample. Older ELISAs utilize chromogenic substrates, though newer assays employ fluorogenic substrates with much higher sensitivity.

In another embodiment, a competitive ELISA is used. Purified antibodies that are directed against a target polypeptide or fragment thereof are coated on the solid phase of multi-well plate, i.e., conjugated to a solid surface. A second batch of purified antibodies that are not conjugated on any solid support is also needed. These non-conjugated purified antibodies are labeled for detection purposes, for example, labeled with horseradish peroxidase to produce a detectable signal. A sample (e.g., a blood sample) from a subject is mixed with a known amount of desired antigen (e.g., a known volume or concentration of a sample comprising a target polypeptide) together with the horseradish peroxidase labeled antibodies and the mixture is then are added to coated wells to form competitive combination. After incubation, if the polypeptide level is high in the sample, a complex of labeled antibody reagent-antigen will form. This complex is free in solution and can be washed away. Washing the wells will remove the complex. Then the wells are incubated with TMB (3, 3', 5, 5'-tetramethylbenzidene) color development substrate for localization of horseradish peroxidase-conjugated antibodies in the wells. There will be no color change or little color change if the target polypeptide level is high in the sample. If there is little or no target polypeptide present in the sample, a different complex in formed, the complex of solid support bound antibody reagents-target polypeptide. This complex is immobilized on the plate and is not washed away in the wash step. Subsequent incubation with TMB will produce significant color change. Such a competitive ELSA test is specific, sensitive, reproducible and easy to operate.

There are other different forms of ELISA, which are well known to those skilled in the art. The standard techniques known in the art for ELISA are described in "Methods in Immunodiagnosis", 2nd Edition, Rose and Bigazzi, eds. John Wiley & Sons, 1980; and Oellerich, M. 1984, J. Clin. Chem. Clin. Biochem. 22:895-904. These references are hereby incorporated by reference in their entirety.

In one embodiment, the levels of a polypeptide in a sample can be detected by a lateral flow immunoassay test (LFIA), also known as the immunochromatographic assay, or strip test. LFIAs are a simple device intended to detect the presence (or absence) of antigen, e.g. a polypeptide, in a fluid sample. There are currently many LFIA tests used for medical diagnostics, either for home testing, point of care testing, or laboratory use. LFIA tests are a form of immunoassay in which the test sample flows along a solid substrate via capillary action. After the sample is applied to the test strip it encounters a colored reagent (generally comprising antibody specific for the test target antigen) bound to microparticles which mixes with the sample and transits the substrate encountering lines or zones which have been pretreated with another antibody or antigen. Depending upon the level of target polypeptides present in the sample the colored reagent can be captured and become bound at the test line or zone. LFIAs are essentially immunoassays adapted to operate along a single axis to suit the test strip format or a dipstick format. Strip tests are extremely versatile and can be easily modified by one skilled in the art for detecting an enormous range of antigens from fluid samples such as urine, blood, water, and/or homogenized tissue samples etc. Strip tests are also known as dip stick tests, the name bearing from the literal action of "dipping" the test strip into a fluid sample to be tested. LFIA strip tests are easy to use, require minimum training and can easily be included as components of point-of-care test (POCT) diagnostics to be use on site in the field. LFIA tests can be operated as either competitive or sandwich assays. Sandwich LFIAs are similar to sandwich ELISA. The sample first encounters colored particles which are labeled with antibodies raised to the target antigen. The test line will also contain antibodies to the same target, although it may bind to a different epitope on the antigen. The test line will show as a colored band in positive samples. In some embodiments of any of the aspects, the lateral flow immunoassay can be a double antibody sandwich assay, a competitive assay, a quantitative assay or variations thereof. Competitive LFIAs are similar to competitive ELISA. The sample first encounters colored particles which are labeled with the target antigen or an analogue. The test line contains antibodies to the target/its analogue. Unlabelled antigen in the sample will block the binding sites on the antibodies preventing uptake of the colored particles. The test line will show as a colored band in negative samples. There are a number of variations on lateral flow technology. It is also possible to apply multiple capture zones to create a multiplex test.

The use of "dip sticks" or LFIA test strips and other solid supports have been described in the art in the context of an immunoassay for a number of antigen biomarkers. U.S. Pat. Nos. 4,943,522; 6,485,982; 6,187,598; 5,770,460; 5,622,871; 6,565,808, U.S. patent application Ser. Nos. 10/278,676; 09/579,673 and 10/717,082, which are incorporated herein by reference in their entirety, are non-limiting examples of such lateral flow test devices. Examples of patents that describe the use of "dip stick" technology to detect soluble antigens via immunochemical assays include, but are not limited to U.S. Pat. Nos. 4,444,880; 4,305,924; and 4,135,884; which are incorporated by reference herein in their entireties. The apparatuses and methods of these three patents broadly describe a first component fixed to a solid surface on a "dip stick" which is exposed to a solution containing a soluble antigen that binds to the component fixed upon the "dip stick," prior to detection of the component-antigen complex upon the stick. It is within the skill of one in the art to modify the teachings of this "dip stick" technology for the detection of polypeptides using antibody reagents as described herein.

Other techniques can be used to detect the level of a polypeptide in a sample. One such technique is the dot blot, an adaptation of Western blotting (Towbin et at., Proc. Nat. Acad. Sci. 76:4350 (1979)). In a Western blot, the polypeptide or fragment thereof can be dissociated with detergents and heat, and separated on an SDS-PAGE gel before being transferred to a solid support, such as a nitrocellulose or PVDF membrane. The membrane is incubated with an antibody reagent specific for the target polypeptide or a fragment thereof. The membrane is then washed to remove unbound proteins and proteins with non-specific binding. Detectably labeled enzyme-linked secondary or detection antibodies can then be used to detect and assess the amount of polypeptide in the sample tested. A dot blot immobilizes a protein sample on a defined region of a support, which is then probed with antibody and labelled secondary antibody as in Western blotting. The intensity of the signal from the detectable label in either format corresponds to the amount of enzyme present, and therefore the amount of polypeptide. Levels can be quantified, for example by densitometry.

In some embodiments of any of the aspects, the level of a target can be measured, by way of non-limiting example, by Western blot; immunoprecipitation; enzyme-linked immunosorbent assay (ELISA); radioimmunological assay (RIA); sandwich assay; fluorescence in situ hybridization (FISH); immunohistological staining; radioimmunometric assay; immunofluoresence assay; mass spectroscopy and/or immunoelectrophoresis assay.

In certain embodiments, the gene expression products as described herein can be instead determined by determining the level of messenger RNA (mRNA) expression of the genes described herein. Such molecules can be isolated, derived, or amplified from a biological sample, such as a blood sample. Techniques for the detection of mRNA expression is known by persons skilled in the art, and can include but not limited to, PCR procedures, RT-PCR, quantitative RT-PCR Northern blot analysis, differential gene expression, RNAse protection assay, microarray based analysis, next-generation sequencing; hybridization methods, etc.

In general, the PCR procedure describes a method of gene amplification which is comprised of (i) sequence-specific hybridization of primers to specific genes or sequences within a nucleic acid sample or library, (ii) subsequent amplification involving multiple rounds of annealing, elongation, and denaturation using a thermostable DNA polymerase, and (iii) screening the PCR products for a band of the correct size. The primers used are oligonucleotides of sufficient length and appropriate sequence to provide initiation of polymerization, i.e. each primer is specifically designed to be complementary to a strand of the genomic locus to be amplified. In an alternative embodiment, mRNA level of gene expression products described herein can be determined by reverse-transcription (RT) PCR and by quantitative RT-PCR (QRT-PCR) or real-time PCR methods. Methods of RT-PCR and QRT-PCR are well known in the art.

In some embodiments of any of the aspects, the level of an mRNA can be measured by a quantitative sequencing technology, e.g. a quantitative next-generation sequence technology. Methods of sequencing a nucleic acid sequence are well known in the art. Briefly, a sample obtained from a subject can be contacted with one or more primers which specifically hybridize to a single-strand nucleic acid sequence flanking the target gene sequence and a complementary strand is synthesized. In some next-generation technologies, an adaptor (double or single-stranded) is ligated to nucleic acid molecules in the sample and synthesis proceeds from the adaptor or adaptor compatible primers. In some third-generation technologies, the sequence can be determined, e.g. by determining the location and pattern of the hybridization of probes, or measuring one or more characteristics of a single molecule as it passes through a sensor (e.g. the modulation of an electrical field as a nucleic acid molecule passes through a nanopore). Exemplary methods of sequencing include, but are not limited to, Sanger sequencing, dideoxy chain termination, high-throughput sequencing, next generation sequencing, 454 sequencing, SOLiD sequencing, polony sequencing, Illumina sequencing, Ion Torrent sequencing, sequencing by hybridization, nanopore sequencing, Helioscope sequencing, single molecule real time sequencing, RNAP sequencing, and the like. Methods and protocols for performing these sequencing methods are known in the art, see, e.g. "Next Generation Genome Sequencing" Ed. Michal Janitz, Wiley-VCH; "High-Throughput Next Generation Sequencing" Eds. Kwon and Ricke, Humanna Press, 2011; and Sambrook et al., Molecular Cloning: A Laboratory Manual (4 ed.), Cold Spring Harbor Laboratory Press, Cold Spring Harbor, N.Y., USA (2012); which are incorporated by reference herein in their entireties.

The nucleic acid sequences of the genes described herein have been assigned NCBI accession numbers for different species such as human, mouse and rat. Accordingly, a skilled artisan can design an appropriate primer based on the known sequence for determining the mRNA level of the respective gene.

Nucleic acid and ribonucleic acid (RNA) molecules can be isolated from a particular biological sample using any of a number of procedures, which are well-known in the art, the particular isolation procedure chosen being appropriate for the particular biological sample. For example, freeze-thaw and alkaline lysis procedures can be useful for obtaining nucleic acid molecules from solid materials; heat and alkaline lysis procedures can be useful for obtaining nucleic acid molecules from urine; and proteinase K extraction can be used to obtain nucleic acid from blood (Roiff, A et al. PCR: Clinical Diagnostics and Research, Springer (1994)).

In some embodiments of any of the aspects, one or more of the reagents (e.g. an antibody reagent and/or nucleic acid probe) described herein can comprise a detectable label and/or comprise the ability to generate a detectable signal (e.g. by catalyzing reaction converting a compound to a detectable product). Detectable labels can comprise, for example, a light-absorbing dye, a fluorescent dye, or a radioactive label. Detectable labels, methods of detecting them, and methods of incorporating them into reagents (e.g. antibodies and nucleic acid probes) are well known in the art.

In some embodiments of any of the aspects, detectable labels can include labels that can be detected by spectroscopic, photochemical, biochemical, immunochemical, electromagnetic, radiochemical, or chemical means, such as fluorescence, chemifluoresence, or chemiluminescence, or any other appropriate means. The detectable labels used in the methods described herein can be primary labels (where the label comprises a moiety that is directly detectable or that produces a directly detectable moiety) or secondary labels (where the detectable label binds to another moiety to produce a detectable signal, e.g., as is common in immunological labeling using secondary and tertiary antibodies). The detectable label can be linked by covalent or non-covalent means to the reagent. Alternatively, a detectable label can be linked such as by directly labeling a molecule that achieves binding to the reagent via a ligand-receptor binding pair arrangement or other such specific recognition molecules. Detectable labels can include, but are not limited to radioisotopes, bioluminescent compounds, chromophores, antibodies, chemiluminescent compounds, fluorescent compounds, metal chelates, and enzymes.

In other embodiments, the detection reagent is label with a fluorescent compound. When the fluorescently labeled reagent is exposed to light of the proper wavelength, its presence can then be detected due to fluorescence. In some embodiments of any of the aspects, a detectable label can be a fluorescent dye molecule, or fluorophore including, but not limited to fluorescein, phycoerythrin, phycocyanin, o-phthaldehyde, fluorescamine, Cy3™, Cy5™, allophycocyanine, Texas Red, peridenin chlorophyll, cyanine, tandem conjugates such as phycoerythrin-Cy5™, green fluorescent protein, rhodamine, fluorescein isothiocyanate (FITC) and Oregon Green™, rhodamine and derivatives (e.g., Texas red and tetrarhodimine isothiocynate (TRITC)), biotin, phycoerythrin, AMCA, CyDyes™, 6-carboxyfluorescein (commonly known by the abbreviations FAM and F), 6-carboxy-2',4',7',4,7-hexachlorofluorescein (HEX), 6-carboxy-4',5'-dichloro-2',7'-dimethoxyfluorescein (JOE or J), N,N,N',N'-tetramethyl-6carboxyrhodamine (TAMRA or T), 6-carboxy-X-rhodamine (ROX or R), 5-carboxyrhodamine-6G (R6G5 or G5), 6-carboxyrhodamine-6G (R6G6 or G6), and rhodamine 110; cyanine dyes, e.g. Cy3, Cy5 and Cy7 dyes; coumarins, e.g umbelliferone; benzimide dyes, e.g. Hoechst 33258; phenanthridine dyes, e.g. Texas Red; ethidium dyes; acridine dyes; carbazole dyes; phenoxazine dyes; porphyrin dyes; polymethine dyes, e.g. cyanine dyes such as Cy3, Cy5, etc; BODIPY dyes and quinoline dyes. In some embodiments of any of the aspects, a detectable label can be a radiolabel including, but not limited to $^{3}H$, $^{125}I$, $^{35}S$, $^{14}C$, $^{32}P$, and $^{33}P$. In some embodiments of any of the aspects, a detectable label can be an enzyme including, but not limited to horseradish peroxidase and alkaline phosphatase. An enzymatic label can produce, for example, a chemiluminescent signal, a color signal, or a fluorescent signal. Enzymes contemplated for use to detectably label an antibody reagent include, but are not limited to, malate dehydrogenase, staphylococcal nuclease, delta-V-steroid isomerase, yeast alcohol dehydrogenase, alpha-glycerophosphate dehydrogenase, triose phosphate isomerase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholinesterase. In some embodiments of any of the aspects, a detectable label is a chemiluminescent label, including, but not limited to lucigenin, luminol, luciferin, isoluminol, theromatic acridinium ester, imidazole, acridinium salt and oxalate ester. In some embodiments of any of the aspects, a detectable label can be a spectral colorimetric label including, but not limited to colloidal gold or colored glass or plastic (e.g., polystyrene, polypropylene, and latex) beads.

In some embodiments of any of the aspects, detection reagents can also be labeled with a detectable tag, such as c-Myc, HA, VSV-G, HSV, FLAG, V5, HIS, or biotin. Other detection systems can also be used, for example, a biotin-streptavidin system. In this system, the antibodies immunoreactive (i. e. specific for) with the biomarker of interest is biotinylated. Quantity of biotinylated antibody bound to the biomarker is determined using a streptavidin-peroxidase conjugate and a chromagenic substrate. Such streptavidin peroxidase detection kits are commercially available, e. g. from DAKO; Carpinteria, CA A reagent can also be detectably labeled using fluorescence emitting metals such as $^{152}Eu$, or others of the lanthanide series. These metals can be attached to the reagent using such metal chelating groups as diethylenetriaminepentaacetic acid (DTPA) or ethylene diaminetetraacetic acid (EDTA).

A level which is less than a reference level can be a level which is less by at least about 10%, at least about 20%, at least about 50%, at least about 60%, at least about 80%, at least about 90%, or less relative to the reference level. In some embodiments of any of the aspects, a level which is less than a reference level can be a level which is statistically significantly less than the reference level.

A level which is more than a reference level can be a level which is greater by at least about 10%, at least about 20%, at least about 50%, at least about 60%, at least about 80%, at least about 90%, at least about 100%, at least about 200%, at least about 300%, at least about 500% or more than the reference level. In some embodiments of any of the aspects, a level which is more than a reference level can be a level which is statistically significantly greater than the reference level.

In some embodiments of any of the aspects, the reference can be a level of the target molecule in a population of subjects who do not have or are not diagnosed as having, and/or do not exhibit signs or symptoms of cancer or diabetes. In some embodiments of any of the aspects, the reference can also be a level of expression of the target molecule in a control sample, a pooled sample of control individuals or a numeric value or range of values based on the same. In some embodiments of any of the aspects, the reference can be the level of a target molecule in a sample obtained from the same subject at an earlier point in time, e.g., the methods described herein can be used to determine if a subject's sensitivity or response to a given therapy is changing over time.

In some embodiments of any of the aspects, the level of expression products of no more than 200 other genes is determined. In some embodiments of any of the aspects, the level of expression products of no more than 100 other genes is determined. In some embodiments of any of the aspects, the level of expression products of no more than 20 other genes is determined. In some embodiments of any of the aspects, the level of expression products of no more than 10 other genes is determined.

In some embodiments of the foregoing aspects, the expression level of a given gene can be normalized relative to the expression level of one or more reference genes or reference proteins.

In some embodiments, the reference level can be the level in a sample of similar cell type, sample type, sample processing, and/or obtained from a subject of similar age, sex and other demographic parameters as the sample/subject for which the level of a gene described herein is to be determined. In some embodiments, the test sample and control reference sample are of the same type, that is, obtained from the same biological source, and comprising the same composition, e.g. the same number and type of cells.

The term "sample" or "test sample" as used herein denotes a sample taken or isolated from a biological organism, e.g., a blood or plasma sample from a subject. In some embodiments of any of the aspects, the present invention encompasses several examples of a biological sample. In some embodiments of any of the aspects, the biological sample is cells, or tissue, or peripheral blood, or bodily fluid. Exemplary biological samples include, but are not limited to, a biopsy, a tumor sample, biofluid sample; blood; serum; plasma; urine; sperm; mucus; tissue biopsy; organ biopsy; synovial fluid; bile fluid; cerebrospinal fluid; mucosal secretion; effusion; sweat; saliva; and/or tissue sample etc. The term also includes a mixture of the above-mentioned samples. The term "test sample" also includes untreated or pretreated (or pre-processed) biological samples. In some embodiments of any of the aspects, a test sample can comprise cells from a subject.

The test sample can be obtained by removing a sample from a subject, but can also be accomplished by using a previously isolated sample (e.g. isolated at a prior timepoint and isolated by the same or another person).

In some embodiments of any of the aspects, the test sample can be an untreated test sample. As used herein, the phrase "untreated test sample" refers to a test sample that has not had any prior sample pre-treatment except for dilution and/or suspension in a solution. Exemplary methods for treating a test sample include, but are not limited to, centrifugation, filtration, sonication, homogenization, heating, freezing and thawing, and combinations thereof. In some embodiments of any of the aspects, the test sample can be a frozen test sample, e.g., a frozen tissue. The frozen sample can be thawed before employing methods, assays and systems described herein. After thawing, a frozen sample can be centrifuged before being subjected to methods, assays and systems described herein. In some embodiments of any of the aspects, the test sample is a clarified test sample, for example, by centrifugation and collection of a supernatant comprising the clarified test sample. In some embodiments of any of the aspects, a test sample can be a pre-processed test sample, for example, supernatant or filtrate resulting from a treatment selected from the group consisting of centrifugation, filtration, thawing, purification, and any combinations thereof. In some embodiments of any of the aspects, the test sample can be treated with a chemical and/or biological reagent. Chemical and/or biological reagents can be employed to protect and/or maintain the stability of the sample, including biomolecules (e.g., nucleic acid and protein) therein, during processing. One exemplary reagent is a protease inhibitor, which is generally used to protect or maintain the stability of protein during processing. The skilled artisan is well aware of methods and processes appropriate for pre-processing of biological samples required for determination of the level of an expression product as described herein.

In some embodiments of any of the aspects, the methods, assays, and systems described herein can further comprise a step of obtaining or having obtained a test sample from a subject. In some embodiments of any of the aspects, the subject can be a human subject. In some embodiments of any of the aspects, the subject can be a subject in need of treatment for (e.g. having or diagnosed as having) cancer or a subject at risk of or at increased risk of developing cancer as described elsewhere herein.

In some embodiments of any of the aspects, the method further comprises determining the expression level of at least one gene selected from TSP5, Snail (SNAI1), Twist (TWIST1), Slug (SNAI2), vimentin (VIM), E-cadherin (CDH1), ZEB1, AHNAK, COMP, TSP5, BRD2, BRD3, miR103a, and SOX2-OT in tumor tissue obtained from the subject. In some embodiments of any of the aspects, the method further comprises determining the expression level of at least one gene selected from COMP, TSP5, BRD2, BRD3, miR103a, and SOX-2-OT in tumor tissue obtained from the subject.

As used herein, the term "cancer" relates generally to a class of diseases or conditions in which abnormal cells divide without control and can invade nearby tissues. Cancer cells can also spread to other parts of the body through the blood and lymph systems. There are several main types of cancer. Carcinoma is a cancer that begins in the skin or in tissues that line or cover internal organs. Sarcoma is a cancer that begins in bone, cartilage, fat, muscle, blood vessels, or other connective or supportive tissue. Leukemia is a cancer that starts in blood-forming tissue such as the bone marrow, and causes large numbers of abnormal blood cells to be produced and enter the blood. Lymphoma and multiple myeloma are cancers that begin in the cells of the immune system. Central nervous system cancers are cancers that begin in the tissues of the brain and spinal cord.

In some embodiments of any of the aspects, the cancer is a primary cancer. In some embodiments of any of the aspects, the cancer is a malignant cancer. As used herein, the term "malignant" refers to a cancer in which a group of tumor cells display one or more of uncontrolled growth (i.e., division beyond normal limits), invasion (i.e., intrusion on and destruction of adjacent tissues), and metastasis (i.e., spread to other locations in the body via lymph or blood). As used herein, the term "metastasize" refers to the spread of cancer from one part of the body to another. A tumor formed by cells that have spread is called a "metastatic tumor" or a "metastasis." The metastatic tumor contains cells that are like those in the original (primary) tumor. As used herein, the term "benign" or "non-malignant" refers to tumors that may grow larger but do not spread to other parts of the body. Benign tumors are self-limited and typically do not invade or metastasize.

A "cancer cell" or "tumor cell" refers to an individual cell of a cancerous growth or tissue. A tumor refers generally to a swelling or lesion formed by an abnormal growth of cells, which may be benign, pre-malignant, or malignant. Most cancer cells form tumors, but some, e.g., leukemia, do not necessarily form tumors. For those cancer cells that form tumors, the terms cancer (cell) and tumor (cell) are used interchangeably.

As used herein the term "neoplasm" refers to any new and abnormal growth of tissue, e.g., an abnormal mass of tissue, the growth of which exceeds and is uncoordinated with that of the normal tissues. Thus, a neoplasm can be a benign neoplasm, premalignant neoplasm, or a malignant neoplasm.

A subject that has a cancer or a tumor is a subject having objectively measurable cancer cells present in the subject's body. Included in this definition are malignant, actively proliferative cancers, as well as potentially dormant tumors or micrometastatses. Cancers which migrate from their original location and seed other vital organs can eventually lead to the death of the subject through the functional deterioration of the affected organs.

Examples of cancer include but are not limited to, carcinoma, lymphoma, blastoma, sarcoma, leukemia, basal cell carcinoma, biliary tract cancer; bladder cancer; bone cancer; brain and CNS cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma (GBM); hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); lymphoma including Hodgkin's and non-Hodgkin's lymphoma; melanoma; myeloma; neuroblastoma; oral cavity cancer (e.g., lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; as well as other carcinomas and sarcomas; as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute lymphoblastic leukemia (ALL); Hairy cell leukemia; chronic myeloblastic leukemia; and post-transplant lymphoproliferative disorder (PTLD), as well as abnormal vascular proliferation associated with phakomatoses, edema (such as that associated with brain tumors), and Meigs' syndrome A "cancer cell" is a cancerous, pre-cancerous, or transformed cell, either in vivo, ex vivo, or in tissue culture, that has spontaneous or induced phenotypic changes that do not necessarily involve the uptake of new genetic material. Although transformation can arise from infection with a transforming virus and incorporation of new genomic nucleic acid, or uptake of exogenous nucleic acid, it can also arise spontaneously or following exposure to a carcinogen, thereby mutating an endogenous gene. Transformation/cancer is associated with, e.g., morphological changes, immortalization of cells, aberrant growth control, foci formation, anchorage independence, malignancy, loss of contact inhibition and density limitation of growth, growth factor or serum independence, tumor specific markers, invasiveness or metastasis, and tumor growth in suitable animal hosts such as nude mice.

In some embodiments of any of the aspects, the cancer is an epithelial cancer. In some embodiments of any of the aspects, the cancer is an epithelial adenocarcinoma. In some embodiments of any of the aspects, the cancer is esophageal cancer, pancreatic cancer, cervical cancer, colorectal cancer, gastric cancer, lung cancer, uterine caner, renal cancer, breast cancer, or prostate cancer. In some embodiments of any of the aspects, the cancer is breast and/or prostate cancer.

In some embodiments of any of the aspects, the subject is diabetic. As used herein, "diabetes" refers to diabetes mellitus, a metabolic disease characterized by a deficiency or absence of insulin secretion by the pancreas. As used throughout, "diabetes" includes Type 1, Type 2, Type 3, and Type 4 diabetes mellitus unless otherwise specified herein. The onset of diabetes is typically due to a combination of hereditary and environmental causes, resulting in abnormally high blood sugar levels (hyperglycemia). The two most common forms of diabetes are due to either a diminished production of insulin (in type 1), or diminished response by the body to insulin (in type 2 and gestational). Both lead to hyperglycemia, which largely causes the acute signs of diabetes: excessive urine production, resulting compensatory thirst and increased fluid intake, blurred vision, unexplained weight loss, lethargy, and changes in energy metabolism. Diabetes can cause many complications. Acute complications (hypoglycemia, ketoacidosis, or nonketotic hyperosmolar coma) may occur if the disease is not adequately controlled. Serious long-term complications (i.e. chronic side effects) include cardiovascular disease (doubled risk), chronic renal failure, retinal damage (which can lead to blindness), nerve damage (of several kinds), and microvascular damage, which may cause impotence and poor wound healing. Poor healing of wounds, particularly of the feet, can lead to gangrene, and possibly to amputation. In some embodiments, the diabetes can be Type 2 diabetes. Type 2 diabetes (non-insulin-dependent diabetes mellitus (NIDDM), or adult-onset diabetes) is a metabolic disorder that is primarily characterized by insulin resistance (diminished response by the body to insulin), relative insulin deficiency, and hyperglycemia. In some embodiments, a subject can be pre-diabetic, which can be characterized, for example, as having elevated fasting blood sugar or elevated post-prandial blood sugar.

Subjects having diabetes can be identified by a physician using current methods of diagnosing diabetes. Symptoms and/or complications of diabetes which characterize this condition and aid in diagnosis are well known in the art and include but are not limited to, weight loss, slow healing, polyuria, polydipsia, polyphagiam headaches, itchy skin, and fatigue. Tests that may aid in a diagnosis of, e.g. diabetes include, but are not limited to, blood tests (e.g., for fasting glucose levels). A family history of diabetes, or exposure to risk factors for diabetes (e.g. overweight) can also aid in determining if a subject is likely to have diabetes or in making a diagnosis of diabetes. In some embodiments of any of the aspects, the subject is identified as diabetic when they are determined to have HbA1c of 6.5% or greater, or by fasting glucose or fasting insulin.

In some embodiments of any of the aspects, the subject is overweight. In some embodiments of any of the aspects, the subject is obese.

The term "obesity" refers to excess fat in the body. Obesity can be determined by any measure accepted and utilized by those of skill in the art. Currently, an accepted measure of obesity is body mass index (BMI), which is a measure of body weight in kilograms relative to the square of height in meters. Generally, for an adult over age 20, a BMI between about 18.5 and 24.9 is considered normal, a BMI between about 25.0 and 29.9 is considered overweight, a BMI at or above about 30.0 is considered obese, and a BMI at or above about 40 is considered morbidly obese. (See, e.g., Gallagher et al. (2000) Am J Clin Nutr 72:694-701.) These BMI ranges are based on the effect of body weight on increased risk for disease. Although BMI correlates with body fat, the relation between BMI and actual body fat differs with age and gender. For example, women are more likely to have a higher percent of body fat than men for the same BMI. Furthermore, the BMI threshold that separates normal, overweight, and obese can vary, e.g. with age, gender, ethnicity, fitness, and body type, amongst other factors. In some embodiments, a subject with obesity can be a subject with a body mass index of at least about 25 kg/m$^2$. In some embodiments, a subject with obesity can be a subject with a body mass index of at least about 30 kg/m$^2$.

As described herein, the inventors have found that the expression patterns of certain genes in exosomes indicate whether the exosome will promote or inhibit cancer progression. Accordingly, administration of exosomes with gene expression patterns indicative of a cancer-inhibiting exosome phenotype can be administered to patients with a therapeutic effect. In one aspect of any of the embodiments, described herein is a method of treating cancer in a subject in need thereof, the method comprising administering to the subject exosomes which are:
  a. from a non-diabetic and/or non-obese donor; and/or
  b. determined to have an level of expression of at least one gene selected from:
    miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
    a level of expression of at least one gene selected from:
    miR424-5p, miR-326, miR424-5p, miR-27a-3p, miR320b and miR320d; which is not increased, wherein the level of expression is relative to the level of expression in a exosome obtained from a healthy non-diabetic subject.

In one aspect of any of the embodiments, described herein is a composition comprising exosomes which are:
  a. from a non-diabetic and/or non-obese donor; and/or
  b. determined to have an level of expression of at least one gene selected from:
    miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
    a level of expression of at least one gene selected from:
    miR424-5p, miR-326, miR424-5p, miR-27a-3p, miR320b and miR320d; which is not increased, wherein the level of expression is relative to the level of expression in a exosome obtained from a healthy non-diabetic subject;
for use in a method of treating cancer in a subject in need thereof.

As described herein, the inventors have discovered that misregulation of certain genes in exosomes drives cancer progression, particularly the epithelial-mesenchymal transition (EMT). Accordingly, administering inhibitors of genes upregulated in cancer-driving exosomes, or agonists of genes downregulated in cancer-driving exosomes can provide therapeutic effects. Accordingly, in one aspect of any of the embodiments, described herein is a method of treating cancer in a subject in need thereof, the method comprising administering to the subject:
  a. an inhibitor of at least one gene selected from:
    miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
  b. an agonist of at least one gene selected from:
    miR424-5p, miR-326, miR424-5p, miR-27a-3p, miR320b and miR320d.

In one aspect of any of the embodiments, described herein is a composition or combination comprising:
  a. an inhibitor of at least one gene selected from:
    miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
  b. an agonist of at least one gene selected from:
    miR424-5p, miR-326, miR424-5p, miR-27a-3p, miR320b and miR320d;
for use in a method of treating cancer in a subject in need thereof.

In some embodiments of any of the aspects, the subject can be administered (or the composition/combination can comprise) one or more of the inhibitors or agonists, e.g., two or more inhibitors, two or more agonists, or at least one inhibitor and at least one agonist. Combinations of reagents include those pair-wise combinations shown in the following table:

| | Inhibitor of miR374a-5p | Inhibitor of miR-93-5p | Inhibitor of miR-28-3p | Inhibitor of miR-let-7b-3p | Inhibitor of miR-375 | Inhibitor of TSP5 | Inhibitor of SNAI1 | Inhibitor of TWIST1 | Inhibitor of SNAI2 | Inhibitor of VIM | Inhibitor of CDH1 |
|---|---|---|---|---|---|---|---|---|---|---|---|
| Inhibitor of miR374a-5p | | x | x | x | x | x | x | x | x | x | x |
| Inhibitor of miR-93-5p | X | | x | x | x | x | x | x | x | x | x |
| Inhibitor of miR-28-3p | X | X | | x | x | x | x | x | x | x | x |
| Inhibitor of miR-let-7b-3p | X | X | x | | x | x | x | x | x | x | x |
| Inhibitor of miR-375 | X | X | x | x | | x | x | x | x | x | x |
| Inhibitor of TSPS | X | X | x | x | x | | x | x | x | x | x |

| | 1 | 2 | 3 | 4 | 5 | 6 | 7 | 8 | 9 | 10 |
|---|---|---|---|---|---|---|---|---|---|---|
| Inhibitor of SNAI1 | X | X | x | x | x | x | | x | x | x | x |
| Inhibitor of TWIST1 | X | X | x | x | x | x | x | | x | x | x |
| Inhibitor of SNAI2 | X | X | x | x | x | x | x | x | | x | x |
| Inhibitor of VIM | X | X | x | x | x | x | x | x | x | | x |
| Inhibitor of CDH1 | X | X | x | x | x | x | x | x | x | x | |
| Inhibitor of ZEB1 | X | X | x | x | x | x | x | x | x | x | x |
| Inhibitor of AHNAK | X | X | x | x | x | x | x | x | x | x | x |
| Agonist of miR424-5p | X | X | x | x | x | x | x | x | x | x | x |
| Agonist of miR-326 | X | X | x | x | x | x | x | x | x | x | x |
| Agonist of miR424-5p | X | X | x | x | x | x | x | x | x | x | x |
| Agonist of miR-27a-3p | X | X | x | x | x | x | x | x | x | x | x |
| Agonist of miR320b | X | X | x | x | x | x | x | x | x | x | x |
| Agonist of miR320d | X | X | x | x | x | x | x | x | x | x | x |

| | Inhibitor of ZEB1 | Inhibitor of AHNAK | Agonist of miR424-5p | Agonist of miR-326 | Agonist of miR424-5p | Agonist of miR27a-3p | Agonist of miR320b | Agonist of miR320d |
|---|---|---|---|---|---|---|---|---|
| Inhibitor of miR374a-5p | x | x | x | x | x | x | x | X |
| Inhibitor of miR-93-5p | x | x | x | x | x | x | x | X |
| Inhibitor of miR-28-3p | x | x | x | x | x | x | x | x |
| Inhibitor of miR-let-7b-3p | x | x | x | x | x | x | x | x |
| Inhibitor of miR-375 | x | x | x | x | x | x | x | x |
| Inhibitor of TSPS | x | x | x | x | x | x | x | x |
| Inhibitor of SNAI1 | x | x | x | x | x | x | x | x |
| Inhibitor of TWIST1 | x | x | x | x | x | x | x | x |
| Inhibitor of SNAI2 | x | x | x | x | x | x | x | x |
| Inhibitor of VIM | x | x | x | x | x | x | x | x |
| Inhibitor of CDH1 | x | x | x | x | x | x | x | x |
| Inhibitor of ZEB1 | | x | x | x | x | x | x | x |
| Inhibitor of AHNAK | x | | x | x | x | x | x | x |
| Agonist of miR424-5p | x | x | | x | x | x | x | x |
| Agonist of miR-326 | x | x | x | | x | x | x | x |
| Agonist of miR424-5p | x | x | x | x | | x | x | x |
| Agonist of miR-27a-3p | x | x | x | x | x | | x | x |
| Agonist of miR320b | x | x | x | x | x | x | | x |
| Agonist of miR320d | x | x | x | x | x | x | x | |

As used herein, "inhibitor" refers to an agent which can decrease the expression and/or activity of a target, e.g. by at least 10% or more, e.g. by 10% or more, 50% or more, 70% or more, 80% or more, 90% or more, 95% or more, or 98% or more. The efficacy of an inhibitor of one or more targets, e.g. its ability to decrease the level and/or activity of the target can be determined, e.g. by measuring the level of an expression product of the target and/or the activity of the target. In some embodiments of any of the aspects, the inhibitor can be an inhibitory nucleic acid; an aptamer; an antibody reagent; an antibody; or a small molecule. An inhibitor of a target described herein can inhibit the activity, expression, or accumulation of the target polypeptide. Inhibitors can include inhibitors that act directly on the target itself (e.g., that bind to the protein or transcript, e.g., direct inhibitors).

In some embodiments of any of the aspects, an inhibitor of a specified target is an antibody, antibody reagent, or antigen-binding fragment thereof, that specifically binds to the target.

In some embodiments of any of the aspects, an inhibitor of a target described herein is an inhibitory nucleic acid. In some embodiments of any of the aspects, inhibitors of the expression of a given gene can be an inhibitory nucleic acid. As used herein, "inhibitory nucleic acid" refers to a nucleic acid molecule which can inhibit the expression of a target, e.g., double-stranded RNAs (dsRNAs), inhibitory RNAs (iRNAs), and the like. In some embodiments of any of the aspects, the inhibitory nucleic acid can be a silencing RNA (siRNA), microRNA (miRNA), or short hairpin RNA (shRNA). Inhibitory nucleic acids can also include guide sequence molecules (e.g., a guide RNA) that function, e.g., in combination with an enzyme, to induce insertions, deletions, indels, and/or mutations of a target, thereby inhibiting the expression of the target.

In some embodiments of any of the aspects, an iNA comprises a sequence that is complementary to at least a portion of a target sequence described herein. In some embodiments of any of the aspects, an iNA comprises a sequence at least 15 nucleotides in length that is complementary to at least a portion of a target sequence described herein. In some embodiments of any of the aspects, an iNA comprises a sequence at least 20 nucleotides in length that is complementary to at least a portion of a target sequence described herein.

In some embodiments of any of the aspects, an iNA comprises a sequence that is the reverse complement to at least a portion of a target sequence described herein. In some embodiments of any of the aspects, an iNA comprises a sequence at least 15 nucleotides in length that is the reverse complement to at least a portion of a target sequence described herein. In some embodiments of any of the aspects, an iNA comprises a sequence at least 20 nucleotides in length that is the reverse complement to at least a portion of a target sequence described herein.

In some embodiments of any of the aspects, an iNA comprises a sequence that can specifically hybridize to at least a portion of a target sequence described herein. In some embodiments of any of the aspects, an iNA comprises a sequence at least 15 nucleotides in length that can specifically hybridize to at least a portion of a target sequence described herein. In some embodiments of any of the aspects, an iNA comprises a sequence at least 20 nucleotides in length that can specifically hybridize to at least a portion of a target sequence described herein.

Double-stranded RNA molecules (dsRNA) have been shown to block gene expression in a highly conserved regulatory mechanism known as RNA interference (RNAi). The inhibitory nucleic acids described herein can include an RNA strand (the antisense strand) having a region which is 30 nucleotides or less in length, i.e., 15-30 nucleotides in length, generally 19-24 nucleotides in length, which region is substantially complementary to at least part the targeted mRNA transcript. The use of these iRNAs enables the targeted degradation of mRNA transcripts, resulting in decreased expression and/or activity of the target.

As used herein, the term "iRNA" refers to an agent that contains RNA (or modified nucleic acids as described below herein) and which mediates the targeted cleavage of an RNA transcript via an RNA-induced silencing complex (RISC) pathway. In some embodiments of any of the aspects, an iRNA as described herein effects inhibition of the expression and/or activity of a target, e.g. a gene described herein. In some embodiments of any of the aspects, contacting a cell with the inhibitor (e.g. an iRNA) results in a decrease in the target mRNA level in a cell by at least about 5%, about 10%, about 20%, about 30%, about 40%, about 50%, about 60%, about 70%, about 80%, about 90%, about 95%, about 99%, up to and including 100% of the target mRNA level found in the cell without the presence of the iRNA. In some embodiments of any of the aspects, administering an inhibitor (e.g. an iRNA) to a subject results in a decrease in the target mRNA level in the subject by at least about 5%, about 10%, about 20%, about 30%, about 40%, about 50%, about 60%, about 70%, about 80%, about 90%, about 95%, about 99%, up to and including 100% of the target mRNA level found in the subject without the presence of the iRNA.

In some embodiments of any of the aspects, the iRNA can be a dsRNA. A dsRNA includes two RNA strands that are sufficiently complementary to hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of the target, e.g., it can span one or more intron boundaries. The other strand (the sense strand) includes a region that is complementary to the antisense strand, such that the two strands hybridize and form a duplex structure when combined under suitable conditions. Generally, the duplex structure is between 15 and 30 base pairs in length inclusive, more generally between 18 and 25 base pairs in length inclusive, yet more generally between 19 and 24 base pairs in length inclusive, and most generally between 19 and 21 base pairs in length, inclusive. Similarly, the region of complementarity to the target sequence is between 15 and 30 base pairs in length inclusive, more generally between 18 and 25 base pairs in length inclusive, yet more generally between 19 and 24 base pairs in length inclusive, and most generally between 19 and 21 base pairs in length nucleotides in length, inclusive. In some embodiments of any of the aspects, the dsRNA is between 15 and 20 nucleotides in length, inclusive, and in other embodiments, the dsRNA is between 25 and 30 nucleotides in length, inclusive. As the ordinarily skilled person will recognize, the targeted region of an RNA targeted for cleavage will most often be part of a larger RNA molecule, often an mRNA molecule. Where relevant, a "part" of an mRNA target is a contiguous sequence of an mRNA target of sufficient length to be a substrate for RNAi-directed cleavage (i.e., cleavage through a RISC pathway). dsRNAs having duplexes as short as 9 base pairs can, under some circumstances, mediate RNAi-directed RNA cleavage. Most often a target will be at least 15 nucleotides in length, preferably 15-30 nucleotides in length.

Exemplary embodiments of types of inhibitory nucleic acids can include, e.g., siRNA, shRNA, miRNA, and/or amiRNA, which are well known in the art. One skilled in the art would be able to design further siRNA, shRNA, or miRNA to target the nucleic acid sequence of a target described herein, e.g., using publically available design tools. siRNA, shRNA, or miRNA is commonly made using companies such as Dharmacon (Layfayette, CO) or Sigma Aldrich (St. Louis, MO).

In some embodiments of the various aspects described herein, the inhibitory nucleic acid is a guide nucleic acid (gNA). As used herein, the terms "guide nucleic acid," "guide sequence," "crRNA," "guide RNA," "single guide RNA," "gRNA" or "CRISPR guide sequence" refer to a nucleic acid comprising a sequence that determines the specificity of an enzyme, e.g., the Cas DNA binding protein of a CRISPR/Cas system, to a polynucleotide target. The gNA can comprise a polynucleotide sequence with at least partial complementarity with a target nucleic acid sequence, sufficient to hybridize with the target nucleic acid sequence and to direct sequence-specific binding of an enzyme, e.g, a nuclease, to the target nucleic acid sequence.

In some embodiments, the enzyme directed by the gNA is a gene-editing protein, e.g., any nuclease that induces a nick or double-strand break into a desired recognition site. Such enzymes can be native or engineered. These breaks can then be repaired by the cell in one of two ways: non-homologous end joining and homology-directed repair (homologous recombination). In non-homologous end joining (NHEJ), the double-strand breaks are repaired by direct ligation of the break ends to one another. As such, no new nucleic acid material is inserted into the site, although some nucleic acid material may be lost, resulting in a deletion. In homology-directed repair, a donor polynucleotide with homology to the cleaved target DNA sequence can be used as a template for repair of the cleaved target DNA sequence, resulting in the transfer of genetic information from the donor polynucleotide to the target DNA. Therefore, new nucleic acid material may be inserted/copied into the site. The modifications of the target DNA due to NHEJ and/or homology-directed repair can be used for gene correction, gene replacement, gene tagging, transgene insertion, nucleotide deletion, gene disruption, gene mutation, etc.

In one embodiment, the gene-editing protein is a CRISPR-associated nuclease. The native prokaryotic CRISPR-associated nuclease system comprises an array of short repeats with intervening variable sequences of constant length (i.e., clusters of regularly interspaced short palindromic repeats), and CRISPR-associated ("Cas") nuclease proteins. The RNA of the transcribed CRISPR array is processed by a subset of the Cas proteins into small guide RNAs, which generally have two components as discussed below. There are at least three different systems: Type I, Type II and Type III. The enzymes involved in the processing of the RNA into mature crRNA are different in the 3 systems. In the native prokaryotic system, the guide RNA ("gRNA") comprises two short, non-coding RNA species referred to as CRISPR RNA ("crRNA") and trans-acting RNA ("tracrRNA"). In an exemplary system, the gRNA forms a complex with a nuclease, for example, a Cas nuclease. The gRNA:nuclease complex binds a target polynucleotide sequence having a protospacer adjacent motif ("PAM") and a protospacer, which is a sequence complementary to a portion of the gRNA. The recognition and binding of the target polynucleotide by the gRNA:nuclease complex induces cleavage of the target.

Any CRISPR-associated nuclease can be used in the system and methods of the invention. CRISPR nuclease systems are known to those of skill in the art, e.g. Cas9, Cas12, Cas12a, or the like, see U.S. Pat. No. 8,993,233, US 2015/0291965, US 2016/0175462, US 2015/0020223, US 2014/0179770, U.S. Pat. Nos. 8,697,359; 8,771,945; 8, 795,965; WO 2015/191693; U.S. Pat. No. 8,889,418; WO 2015/089351; WO 2015/089486; WO 2016/028682; WO 2016/049258; WO 2016/094867; WO 2016/094872; WO 2016/094874; WO 2016/112242; US 2016/0153004; US 2015/0056705; US 2016/0090607; US 2016/0029604; U.S. Pat. Nos. 8,865,406; 8,871,445; each of which are incorporated by reference in their entirety. The nuclease can also be a phage Cas nuclease, e.g., CasΦ (e.g., Pausch et al. Science 369:333-7 (2020); which is incorporated by reference herein in its entirety).

The full-length guide nucleic acid strand can be any length. For example, the guide nucleic acid strand can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments of the various aspects described herein, a nucleic acid strand is less than about 75, 50, 45, 40, 35, 30, 25, 20, 15, 12, or fewer nucleotides in length. For example, the guide nucleic acid sequence is 10-30 nucleotides long.

In addition to a sequence that is complementary to a target nucleic acid, in some embodiments, the gNA also comprises a scaffold sequence. Expression of a gNA encoding both a sequence complementary to a target nucleic acid and scaffold sequence has the dual function of both binding (hybridizing) to the target nucleic acid and recruiting the endonuclease to the target nucleic acid, which may result in site-specific CRISPR activity. In some embodiments, such a chimeric gNA may be referred to as a single guide RNA (sgRNA).

In some embodiments of the various aspects described herein, the guide nucleic acid is designed using a guide design tool (e.g., Benchling™; Broad Institute GPP™; CasOFFinder™; CHOPCHOP™; CRISPOR™; Deskgen™; E-CRISP™; Geneious™; GenHub™; GUIDES™ (e.g., for library design); Horizon Discovery™; IDT™; Off-Spotter™; and Synthego™; which are available on the world wide web).

In some embodiments of any of the aspects, the RNA of an iRNA, e.g., a dsRNA, is chemically modified to enhance stability or other beneficial characteristics. The nucleic acids described herein may be synthesized and/or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, (a) end modifications, e.g., 5' end modifications (phosphorylation, conjugation, inverted linkages, etc.) 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position) or replacement of the sugar, as well as (d) backbone modifications, including modification or replacement of the phosphodiester linkages. Specific examples of RNA compounds useful in the embodiments described herein include, but are not limited to RNAs containing modified backbones or no natural internucleoside linkages.

RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments of any of the aspects, the modified RNA will have a phosphorus atom in its internucleoside backbone.

Modified RNA backbones can include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included. Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; others having mixed N, O, S and CH2 component parts, and oligonucleosides with heteroatom backbones, and in particular —CH2-NH—CH2-, —CH2-N(CH3)-O—CH2-[known as a methylene (methylimino) or MMI backbone], —CH2-O—N(CH3)-CH2-, —CH2-N(CH3)-N(CH3)-CH2- and —N(CH3)-CH2-CH2- [wherein the native phosphodiester backbone is represented as —O—P—O—CH2-].

In other RNA mimetics suitable or contemplated for use in iRNAs, both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mol Canc Ther 6(3):833-843; Grunweller, A. et al., (2003) Nucleic Acids Research 31(12): 3185-3193).

Modified RNAs can also contain one or more substituted sugar moieties. The iRNAs, e.g., dsRNAs, described herein can include one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted C1 to C10 alkyl or C2 to C10 alkenyl and alkynyl. Exemplary suitable modifications include O[(CH2)nO] mCH3, O(CH2)·nOCH3, O(CH2)nNH2, O(CH2) nCH3, O(CH2)nONH2, and O(CH2)nON[(CH2)nCH3)]2, where n and m are from 1 to about 10. In some embodiments of any of the aspects, dsRNAs include one of the following at the 2' position: C1 to C10 lower alkyl, substituted lower alkyl, alkaryl, aralkyl, O-alkaryl or O-aralkyl, SH, SCH3, OCN, Cl, Br, CN, CF3, OCF3, SOCH3, SO2CH3, ONO2, NO2, N3, NH2, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments of any of the aspects, the modification includes a 2' methoxyethoxy (2'-O—CH2CH2OCH3, also known as 2'-O-(2-methoxyethyl) or 2'-MOE) (Martin et al., Hely. Chim. Acta, 1995, 78:486-504) i.e., an alkoxy-alkoxy group. Another exemplary modification is 2'-dimethylaminooxyethoxy, i.e., a O(CH2)2ON(CH3)2 group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH2-O—CH2-N(CH2)2, also described in examples herein below.

Other modifications include 2'-methoxy (2'-OCH3), 2'-aminopropoxy (2'-OCH2CH2CH2NH2) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs may also have sugar mimetics such as cyclobutyl moieties in place of the pentofuranosyl sugar.

An inhibitory nucleic acid can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Certain of these nucleobases are particularly useful for increasing the binding affinity of the inhibitory nucleic acids featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

The preparation of the modified nucleic acids, backbones, and nucleobases described above are well known in the art.

Another modification of an inhibitory nucleic acid featured in the invention involves chemically linking to the inhibitory nucleic acid to one or more ligands, moieties or conjugates that enhance the activity, cellular distribution, pharmacokinetic properties, or cellular uptake of the iRNA. Such moieties include but are not limited to lipid moieties such as a cholesterol moiety (Letsinger et al., Proc. Natl. Acid. Sci. USA, 1989, 86: 6553-6556), cholic acid (Manoharan et al., Biorg. Med. Chem. Let., 1994, 4:1053-1060), a thioether, e.g., beryl-S-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain, e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54), a phospholipid, e.g., di-hexadecyl-rac-glycerol or triethyl-ammonium 1,2-di-O-hexadecyl-rac-glycero-3-phosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim. Biophys. Acta, 1995, 1264:229-237), or an octadecylamine or hexylaminocarbonyloxycholesterol moiety (Crooke et al., J. Pharmacol. Exp. Ther., 1996, 277:923-937).

In some embodiments of any of the aspects, an inhibitor of a target described herein can comprise an antibody reagent. Antibody reagents specific for the targets and/or markers described herein, are known in the art. For example, such reagents are readily commercially available as shown in Table 1 below.

TABLE 1

Exemplary antibodies

| Name | Company | Catalog Number |
|---|---|---|
| Human COMP monoclonal antibody | ProteinTech | 66793-1-Ig |
| Anti-COMP (Thrombospondin-5) Antibody, clone 484D1 | Millipore Sigma | MABT36 |
| Anti-Thrombospondin 5 Antibody (F-7) | Santa Cruz Biotechnologies | sc-374660 |
| Anti-Thrombospondin 5 Antibody (MA37C94) | Santa Cruz Biotechnologies | sc-59941 |
| Anti-Thrombospondin 5 Antibody (644A8D5) | Santa Cruz Biotechnologies | sc-33696 |
| Human COMP/Thrombospondin-5 Antibody | R&D Systems | MAB3134 |
| Monoclonal Anti-SNAI1 antibody produced in mouse | Millipore Sigma | SAB1404386-100UG |
| Anti-SNAI1 Antibody, clone 10H4.1 | Millipore Sigma | MABE167 |
| Monoclonal Anti-SNAI1 antibody produced in mouse (clone CL3700) | Millipore Sigma | AMAB91215-25UL |
| SNAIL Monoclonal Antibody (F.31.8) | Invitrogen | MA5-14801 |
| SNAI1/Snail antibody (mAb) Clone:9H2 | Active Motif | Catalog No: 61367 |
| Anti-SNAI1 monoclonal antibody (clone 7E3) | Creative Diagnostics | DCABH-2356 |
| Anti-SNAI1 monoclonal antibody (ToOI3) | Creative Diagnostics | DCABH-6168 |
| Anti-Human SNAIL monoclonal antibody (clone G.42.9) | Creative Diagnostics | CABT-L1601 |
| Anti-SNAI 1 Antibody (G-7) | Santa Cruz Biotechnologies | sc-271977 |
| Anti-SNAI 1 Antibody (E-10) | Santa Cruz Biotechnologies | sc-393172 |
| TWIST1 (E7E2G) Rabbit mAb | Cell Signaling Technology | #69366 |
| TWIST1 Monoclonal Antibody (2F8E7) | Invitrogen | MA5-17195 |
| TWIST1 Monoclonal Antibody (10E4E6) | Invitrogen | MA5-38652 |
| TWIST1 Monoclonal Antibody (3E1) | Invitrogen | MA5-32927 |
| TWIST1 Monoclonal Antibody (2F8) | Abnova | H00007291-M03 |
| Twist-1 Antibody (3A2) | Novus Biologicals | H00007291-M04 |
| Anti-twist Antibody (Twist2C1a) | Santa Cruz Biotechnologies | sc-81417 |
| Anti-SLUG Antibody (A-7) | Santa Cruz Biotechnologies | sc-166476 |
| Slug (C19G7) Rabbit mAb | Cell Signaling Technology | #9585 |
| PE Mouse anti-SNAI2/Slug (Clone S43-1259) | BD Biosciences | 564615 |
| SLUG Monoclonal Antibody (OTI1A6) | Invitrogen | MA5-26385 |
| SNAI2 Monoclonal Antibody (OTI1G7) | Origene | TA800196 |
| SLUG Monoclonal Antibody (4B6D5) | Invitrogen | MA5-38634 |
| SNAI2 Monoclonal Antibody (3C12) | Abnova | H00006591-M05 |
| Anti-SNAI2 monoclonal antibody (2H8) | Creative Diagnostics | DCABH-2021 |
| Anti-Vimentin Antibody (E-5) | Santa Cruz Biotechnologies | sc-373717 |
| Vimentin Antibody (280618) | Novus Biologicals | MAB2105 |
| Vimentin Antibody (2D1) | Novus Biologicals | NBP1-92687 |
| Vimentin Monoclonal Antibody (VIM 3B4) | Progen | 61013PROGEN |
| Vimentin Antibody (VIM/1937R) | Novus Biologicals | NBP3-08936 |
| Anti-Vimentin Antibody (V9) | Santa Cruz Biotechnologies | sc-6260 |
| Vimentin Monoclonal Antibody (J144) | Invitrogen | MA3-745 |
| Vimentin Monoclonal Antibody (RV202) | Invitrogen | OMA1-06001 |
| VIM Monoclonal Antibody (OTI1A9), TrueMAB ™ | Origene | TA801297 |
| Anti-E-cadherin Antibody (67A4) | Santa Cruz Biotechnologies | sc-21791 |
| Anti-E Cadherin antibody [CDH1/1525] | Abcam | ab219332 |
| E-cadherin Monoclonal Antibody (SHE78-7) | Invitrogen | # 13-5700 |
| E-cadherin Monoclonal Antibody (HECD-1) | Invitrogen | # 13-1700 |
| CDH1 Monoclonal Antibody (UMAB184), UltraMAB ™ | Origene | # UM800076 |
| E-Cadherin Monoclonal Antibody (4A2C7) | AbboMax | # 605-730 |
| E-cadherin Monoclonal Antibody (6B11F11) | Proteintech | # 60335-1-IG |
| Anti-ZEB1 Antibody (H-3) | Santa Cruz Biotechnologies | sc-515797 |

TABLE 1-continued

Exemplary antibodies

| Name | Company | Catalog Number |
|---|---|---|
| ZEB1 Monoclonal Antibody (3G6), eBioscience ™ | Invitrogen | # 14-9741-82 |
| ZEB1 Monoclonal Antibody (OTI3G6), TrueMAB ™ | Origene | # TA802298 |
| ZEB1 Monoclonal Antibody (1H1F1) | Proteintech | # 66279-1-IG |
| ZEB1 Recombinant Rabbit Monoclonal Antibody (BLR102H) | Bethyl Laboratories | # A700-102 |
| ZEB1 Monoclonal Antibody (OTI7E12), TrueMAB ™ | OriGene | # CF802313 |
| Anti-AHNAK Antibody (E-5) | Santa Cruz Biotechnologies | sc-390743 |
| Anti-AHNAK Antibody (1G11) | Santa Cruz Biotechnologies | sc-134252 |
| AHNAK Monoclonal Antibody (EM-09) | Invitrogen | # MA1-10050 |
| AHNAK Monoclonal Antibody (3G7) | Abnova | # H00079026-M01 |
| Anti-AHNAK monoclonal antibody (clone FN-10) | Creative Diagnostics | DCABH-9479 |
| AHNAK polyclonal antibody (A01) | Abnova | # H00079026-A01 |
| AHNAK Antibody (clone 2014C3a) LS-C342403 | LifeSpan Biosciences | LS-C342403 |

In some embodiments of any of the aspects, an antibody reagent specific for a target and/or maker described herein (e.g., that binds specifically to and inhibits the target and/or marker) can be an antibody reagent comprising one or more (e.g., one, two, three, four, five, or six) CDRs of any one of the antibodies recited in Table 1. In some embodiments of any of the aspects, an antibody reagent specific for a target and/or maker described herein (e.g., that binds specifically to and inhibits the target and/or marker) can be an antibody reagent comprising the six CDRs of any one of the antibodies recited in Table 1. In some embodiments of any of the aspects, an antibody reagent specific for a target and/or maker described herein (e.g., that binds specifically to and inhibits the target and/or marker) can be an antibody reagent comprising the three heavy chain CDRs of any one of the antibodies recited in Table 1. In some embodiments of any of the aspects, an antibody reagent specific for a target and/or maker described herein (e.g., that binds specifically to and inhibits the target and/or marker) can be an antibody reagent comprising the three light chain CDRs of any one of the antibodies recited in Table 1. In some embodiments of any of the aspects, an antibody reagent specific for a target and/or maker described herein (e.g., that binds specifically to and inhibits the target and/or marker) can be an antibody reagent comprising the VH and/or VL domains of any one of the antibodies recited in Table 1. In some embodiments of any of the aspects, an antibody reagent specific for a target and/or maker described herein (e.g., that binds specifically to and inhibits the target and/or marker) can be an antibody reagent comprising the VH and VL domains of any one of the antibodies recited in Table 1. Such antibody reagents are specifically contemplated for use in the methods and/or compositions described herein.

As used herein, the term "agonist" refers to an agent which increases the expression and/or activity of the target by at least 10% or more, e.g. by 10% or more, 50% or more, 100% or more, 200% or more, 500% or more, or 1000% or more. The efficacy of an agonist, e.g. its ability to increase the level and/or activity of the target can be determined, e.g. by measuring the level of an expression product of the target and/or the activity of the target. Methods for measuring the level of a given mRNA and/or polypeptide are known to one of skill in the art, e.g. RTPCR with primers can be used to determine the level of RNA, and Western blotting with an antibody can be used to determine the level of a polypeptide. Suitable primers for a given target are readily identified by one of skill in the art, e.g., using software widely available for this purpose (e.g., Primer3 or PrimerBank, which are both available on the world wide web). Antibodies to polypeptide gene expression products of the immune response regulators described herein are commercially available, e.g., from AbCam (Cambridge, MA). Assays for measuring the activity of the targets described herein are provided elsewhere herein. In some embodiments of any of the aspects, an agonist of a given polypeptide can be the polypeptide, a nucleic acid encoding the polypeptide, or a small molecule.

Non-limiting examples of agonists of a given polypeptide target, can include the target polypeptides or variants or functional fragments thereof and nucleic acids encoding the polypeptide or variants or functional fragments thereof. In some embodiments of any of the aspects, the agonist of a given target, is a polypeptide of that target or variants or functional fragment thereof and/or a nucleic acid encoding the polypeptide or variant or functional fragment thereof. In some embodiments of any of the aspects, the polypeptide agonist can be an engineered and/or recombinant polypeptide. In some embodiments of any of the aspects, the polypeptide agonist can be a nucleic acid encoding a polypeptide, e.g. a functional fragment thereof. In some embodiments of any of the aspects, the nucleic acid can be comprised by a vector.

In some embodiments of any of the aspects, a polypeptide agonist can comprise one of the sequences described herein for each target. In some embodiments of any of the aspects, a polypeptide agonist can consist essentially of one of the sequences provided below herein for each target. In some embodiments of any of the aspects, a polypeptide agonist can consist of one of the sequences provided below herein for each target. In some embodiments of any of the aspects, an agonist can comprise a nucleic acid encoding one of the sequences provided below herein for each target. In some embodiments of any of the aspects, an agonist can be a polypeptide comprising a reference/wild-type sequence described herein with at least 80%, at least 85%, at least 90%, at least 95%, or at least 98% identity to the reference/wild-type sequence and which retains the activity of the reference/wild-type sequence. In some embodiments of any of the aspects, an agonist can be a polypeptide comprising a reference/wild-type sequence described herein with at least 95% identity to the reference/wild-type sequence and which retains the activity of the reference/wild-type sequence.

In some embodiments of any of the aspects, the agonist is an exogenous polypeptide. In some embodiments of any of the aspects, the subject is administered exogenous polypeptide, e.g., the polypeptide is produced in vitro and/or synthesized and purified polypeptide is provided to the subject. In some embodiments of any of the aspects, the agonist is an ectopic polypeptide. In some embodiments of any of the aspects, the subject is administered ectopic polypeptide, e.g., the polypeptide is produced in vitro and/or synthesized and purified polypeptide is provided to the subject.

In some embodiments of any of the aspects, the agonist can be a nucleic acid encoding a polypeptide (or a variant or functional fragment thereof) and/or a vector comprising a nucleic acid encoding a polypeptide (or a variant or functional fragment thereof). A nucleic acid encoding a polypeptide can be, e.g., an RNA molecule, a plasmid, and/or an expression vector. In some embodiments of any of the aspects, the nucleic acid encoding a polypeptide can be an mRNA. In some embodiments of any of the aspects, the nucleic acid encoding a polypeptide can be a modified mRNA. In some embodiments of any of the aspects, the agonist can be a nucleic acid encoding a polypeptide, e.g., exogenous and/or ectopic polypeptide. In some embodiments of any of the aspects, the subject is administered the nucleic acid encoding exogenous and/or ectopic polypeptide, e.g., the nucleic acid is transcribed and/or translated after the administering step to provide exogenous and/or ectopic polypeptide to the subject.

In some embodiments of any of the aspects, a polypeptide or nucleic acid as described herein can be engineered. As used herein, "engineered" refers to the aspect of having been manipulated by the hand of man. For example, a polypeptide is considered to be "engineered" when at least one aspect of the polypeptide, e.g., its sequence, has been manipulated by the hand of man to differ from the aspect as it exists in nature. As is common practice and is understood by those in the art, progeny of an engineered cell are typically still referred to as "engineered" even though the actual manipulation was performed on a prior entity.

In some embodiments of any of the aspects, the agonist and/or inhibitor is administered as a nucleic acid. In some embodiments of any of the aspects, a nucleic acid encoding the agonist and/or inhibitor is administered. In some embodiments of any of the aspects, the subject is administered a vector comprising a nucleic acid. Vectors can be, e.g., a DNA or RNA vector.

In some embodiments of any of the aspects, the methods described herein relate to treating a subject having or diagnosed as having cancer with a composition or combination as described herein. Subjects having cancer can be identified by a physician using current methods of diagnosing cancer. Symptoms and/or complications of cancer which characterize these conditions and aid in diagnosis are well known in the art and include but are not limited to, for example, a lump/mass/tumor, swelling, or pain. Tests that may aid in a diagnosis of, e.g. cancer include, but are not limited to, x-rays, MRI, ultrasound, a biopsy, or tests for the function/activity of affected organs or systems. A family history of cancer or exposure to risk factors for cancer (e.g. smoke, radiation, pollutants, mutation, etc.) can increase the risk of a subject having cancer.

In some embodiments of any of the aspects, the subject is one determined to have an increased level of expression of at least one gene selected from:

miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from:

miR424-5p, miR-326, miR424-5p, miR-27a-3p, miR320b and miR320d.

In some embodiments of any of the aspects, the method further comprises a first step of determining, in the subject or a sample obtained from the subject, the level of expression of at least one gene selected from:

miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; miR424-5p, miR-326, miR424-5p, miR-27a-3p, miR320b and miR320d.

In some embodiments of any of the aspects, the method further comprises a first step of determining that the subject has an increased level of expression of at least one gene selected from:

miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or a decreased level of expression of at least one gene selected from:

miR424-5p, miR-326, miR424-5p, miR-27a-3p, miR320b and miR320d.

The compositions and methods described herein can be administered to a subject having or diagnosed as having cancer. In some embodiments of any of the aspects, the methods described herein comprise administering an effective amount of compositions described herein to a subject in order to alleviate a symptom of a cancer. As used herein, "alleviating a symptom" of a cancer is ameliorating any condition or symptom associated with the cancer. As compared with an equivalent untreated control, such reduction is by at least 5%, 10%, 20%, 40%, 50%, 60%, 80%, 90%, 95%, 99% or more as measured by any standard technique. A variety of means for administering the compositions described herein to subjects are known to those of skill in the art. Such methods can include, but are not limited to oral, parenteral, intravenous, intramuscular, subcutaneous, transdermal, airway (aerosol), pulmonary, cutaneous, topical, injection, or intratumoral administration. Administration can be local or systemic. In some embodiments of any of the apsects, the administration is subcutaneous.

In some embodiments of any of the aspects, the subject in need of treatment for cancer, or the subject administered a composition or combination as described herein is diabetic. In some embodiments of any of the aspects, the subject in need of treatment for cancer, or the subject administered a composition or combination as described herein is obese. In some embodiments of any of the aspects, the subject in need of treatment for cancer, or the subject administered a composition or combination as described herein is diabetic and obese.

In some embodiments of any of the aspects, the methods of treatment described herein reduce EMT in the subject. EMT is a process by which epithelial cells lose their cell polarity and cell-cell adhesion, and gain migratory and invasive properties to become mesenchymal stem cells. EMT can be detected by measuring the expression of EMT marker genes, e.g, increases in N-cadherin, fibronectin, and/or vimentin and/or a decrease in E-cadherin in cancer cells are markers of EMT. In some embodiments of any of the aspects, the methods of treatment described herein reduce metastasis in the subject.

The term "effective amount" as used herein refers to the amount of a composition or combination needed to alleviate at least one or more symptom of the disease or disorder, and relates to a sufficient amount of pharmacological composition to provide the desired effect. The term "therapeutically effective amount" therefore refers to an amount of an agent or composition that is sufficient to provide a particular anti-cancer effect when administered to a typical subject, e.g., a decrease in tumor size, tumor growth, or EMT prevalance or rate. An effective amount as used herein, in various contexts, would also include an amount sufficient to delay the development of a symptom of the disease, alter the course of a symptom disease (for example but not limited to, slowing the progression of a symptom of the disease), or reverse a symptom of the disease. Thus, it is not generally practicable to specify an exact "effective amount". However, for any given case, an appropriate "effective amount" can be determined by one of ordinary skill in the art using only routine experimentation.

Effective amounts, toxicity, and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dosage can vary depending upon the dosage form employed and the route of administration utilized. The dose ratio between toxic and therapeutic effects is the therapeutic index and can be expressed as the ratio LD50/ED50. Compositions and methods that exhibit large therapeutic indices are preferred. A therapeutically effective dose can be estimated initially from cell culture assays. Also, a dose can be formulated in animal models to achieve a circulating plasma concentration range that includes the IC50 (i.e., the concentration of the active ingredient, which achieves a half-maximal inhibition of symptoms) as determined in cell culture, or in an appropriate animal model. Levels in plasma can be measured, for example, by high performance liquid chromatography. The effects of any particular dosage can be monitored by a suitable bioassay, e.g., assay for EMT, among others. The dosage can be determined by a physician and adjusted, as necessary, to suit observed effects of the treatment.

Effective amounts, toxicity, and therapeutic efficacy can be determined by standard pharmaceutical procedures in cell cultures or experimental animals, e.g., for determining the minimal effective dose and/or maximal tolerated dose. The dosage can vary depending upon the dosage form employed and the route of administration utilized. A therapeutically effective dose can be estimated initially from cell culture assays. Also, a dose can be formulated in animal models to achieve a dosage range between the minimal effective dose and the maximal tolerated dose. The effects of any particular dosage can be monitored by a suitable bioassay, e.g., assay for tumor growth and/or size among others. The dosage can be determined by a physician and adjusted, as necessary, to suit observed effects of the treatment.

In some embodiments, the technology described herein relates to a pharmaceutical composition comprising an exosome, inhibitor, agonist, and/or other reagents as described herein, and optionally a pharmaceutically acceptable carrier. In some embodiments, the active ingredients of the pharmaceutical composition comprise an exosome, inhibitor, agonist, and/or other reagents as described herein. In some embodiments, the active ingredients of the pharmaceutical composition consist essentially of an exosome, inhibitor, agonist, and/or other reagents as described herein. In some embodiments, the active ingredients of the pharmaceutical composition consist of an exosome, inhibitor, agonist, and/or other reagents as described herein. Pharmaceutically acceptable carriers and diluents include saline, aqueous buffer solutions, solvents and/or dispersion media. The use of such carriers and diluents is well known in the art. Some non-limiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) $C_2$-$C_{12}$ alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein. In some embodiments, the carrier inhibits the degradation of the active agent, e.g. an exosome, inhibitor, agonist, and/or other reagents as described herein.

In some embodiments, the pharmaceutical composition comprising an exosome, inhibitor, agonist, and/or other reagents as described herein can be a parenteral dose form. Since administration of parenteral dosage forms typically bypasses the patient's natural defenses against contaminants, parenteral dosage forms are preferably sterile or capable of being sterilized prior to administration to a patient. Examples of parenteral dosage forms include, but are not limited to, solutions ready for injection, dry products ready to be dissolved or suspended in a pharmaceutically acceptable vehicle for injection, suspensions ready for injection, and emulsions. In addition, controlled-release parenteral dosage forms can be prepared for administration of a patient, including, but not limited to, DUROS®-type dosage forms and dose-dumping.

Suitable vehicles that can be used to provide parenteral dosage forms of a composition or combination as disclosed within are well known to those skilled in the art. Examples include, without limitation: sterile water; water for injection USP; saline solution; glucose solution; aqueous vehicles such as but not limited to, sodium chloride injection, Ringer's injection, dextrose Injection, dextrose and sodium chloride injection, and lactated Ringer's injection; water-miscible vehicles such as, but not limited to, ethyl alcohol, polyethylene glycol, and propylene glycol; and non-aqueous vehicles such as, but not limited to, corn oil, cottonseed oil, peanut oil, sesame oil, ethyl oleate, isopropyl myristate, and benzyl benzoate. Compounds that alter or modify the solubility of a pharmaceutically acceptable salt of an active ingredient as disclosed herein can also be incorporated into the parenteral dosage forms of the disclosure, including conventional and controlled-release parenteral dosage forms.

Pharmaceutical compositions comprising an exosome, inhibitor, agonist, and/or other reagents can also be formulated to be suitable for oral administration, for example as discrete dosage forms, such as, but not limited to, tablets (including without limitation scored or coated tablets), pills, caplets, capsules, chewable tablets, powder packets, cachets, troches, wafers, aerosol sprays, or liquids, such as but not limited to, syrups, elixirs, solutions or suspensions in an aqueous liquid, a non-aqueous liquid, an oil-in-water emulsion, or a water-in-oil emulsion. Such compositions contain a predetermined amount of the pharmaceutically acceptable salt of the disclosed compounds, and may be prepared by methods of pharmacy well known to those skilled in the art. See generally, Remington: The Science and Practice of Pharmacy, 21st Ed., Lippincott, Williams, and Wilkins, Philadelphia PA (2005).

Conventional dosage forms generally provide rapid or immediate drug release from the formulation. Depending on the pharmacology and pharmacokinetics of the drug, use of conventional dosage forms can lead to wide fluctuations in the concentrations of the drug in a patient's blood and other tissues. These fluctuations can impact a number of parameters, such as dose frequency, onset of action, duration of efficacy, maintenance of therapeutic blood levels, toxicity, side effects, and the like. Advantageously, controlled-release formulations can be used to control a drug's onset of action, duration of action, plasma levels within the therapeutic window, and peak blood levels. In particular, controlled- or extended-release dosage forms or formulations can be used to ensure that the maximum effectiveness of a drug is achieved while minimizing potential adverse effects and safety concerns, which can occur both from under-dosing a drug (i.e., going below the minimum therapeutic levels) as well as exceeding the toxicity level for the drug. In some embodiments, the composition or combination can be administered in a sustained release formulation.

Controlled-release pharmaceutical products have a common goal of improving drug therapy over that achieved by their non-controlled release counterparts. Ideally, the use of an optimally designed controlled-release preparation in medical treatment is characterized by a minimum of drug substance being employed to cure or control the condition in a minimum amount of time. Advantages of controlled-release formulations include: 1) extended activity of the drug; 2) reduced dosage frequency; 3) increased patient compliance; 4) usage of less total drug; 5) reduction in local or systemic side effects; 6) minimization of drug accumulation; 7) reduction in blood level fluctuations; 8) improvement in efficacy of treatment; 9) reduction of potentiation or loss of drug activity; and 10) improvement in speed of control of diseases or conditions. Kim, Cherng-ju, Controlled Release Dosage Form Design, 2 (Technomic Publishing, Lancaster, PA: 2000).

Most controlled-release formulations are designed to initially release an amount of drug (active ingredient) that promptly produces the desired therapeutic effect, and gradually and continually release other amounts of drug to maintain this level of therapeutic or prophylactic effect over an extended period of time. In order to maintain this constant level of drug in the body, the drug must be released from the dosage form at a rate that will replace the amount of drug being metabolized and excreted from the body. Controlled-release of an active ingredient can be stimulated by various conditions including, but not limited to, pH, ionic strength, osmotic pressure, temperature, enzymes, water, and other physiological conditions or compounds.

A variety of known controlled- or extended-release dosage forms, formulations, and devices can be adapted for use with the salts and compositions of the disclosure. Examples include, but are not limited to, those described in U.S. Pat. Nos.: 3,845,770; 3,916,899; 3,536,809; 3,598,123; 4,008,719; 5674,533; 5,059,595; 5,591,767; 5,120,548; 5,073,543; 5,639,476; 5,354,556; 5,733,566; and 6,365,185 B1; each of which is incorporated herein by reference. These dosage forms can be used to provide slow or controlled-release of one or more active ingredients using, for example, hydroxypropylmethyl cellulose, other polymer matrices, gels, permeable membranes, osmotic systems (such as OROS® (Alza Corporation, Mountain View, Calif. USA)), or a combination thereof to provide the desired release profile in varying proportions.

In some embodiments of any of the aspects, a composition or combination described herein is administered as a monotherapy, e.g., another treatment for the cancer is not administered to the subject.

In some embodiments of any of the aspects, the methods described herein can further comprise administering a second agent and/or treatment to the subject, e.g. as part of a combinatorial therapy. Non-limiting examples of a second agent and/or treatment can include radiation therapy, surgery, gemcitabine, cisplastin, paclitaxel, carboplatin, bortezomib, AMG479, vorinostat, ntuximab, temozolomide, rapamycin, ABT-737, PI-103; alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin, especially calicheamicin gamma1I and calicheamicin omega1I (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antiobiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate;

hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylornithine (DMFO); retinoids such as retinoic acid; capecitabine; combretastatin; leucovorin (LV); oxaliplatin, including the oxaliplatin treatment regimen (FOLFOX); lapatinib (Tykerb®); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above.

In addition, the methods of treatment can further include the use of radiation or radiation therapy. Further, the methods of treatment can further include the use of surgical treatments.

In some embodiments of any of the aspects, the method of treatment described herein further comprises administering a BET inhibitor. In some embodiments of any of the aspects, described herein is the combination of a) an exosome, inhibitor, and/or agonist and b) a BET inhibitor, for use in treating cancer. Bromodomain and Extra-Terminal domain (BET) family proteins are epigenetic regulatory factors related to the expression of multiple oncogenes. BET inhibitors are a class of drugs that reversibly bind the bromodomains of BET proteins and prevent protein-protein interaction between BET proteins and acetylated histones and transcription factors to control DNA transcription. Examples of BET inhibitors include but are not limited to: ABBV-075, ABBV-744, BAY1238097, BI 894999, BMS-986158, CPI-203, CPI-0610, CPI-1205, FT-1101, GS-5829, GSK-046, GSK-726, GSK525762, I-BET762, GSK525762A, GSK2820151, I-BET151, INCB054329, OTX015/MK-8628, PLX51107, RO6870810, TEN-010, ZEN003694, CPI-0610, JQ1, RVX-208, MS417, SJ432, AZD5153, INCB054329, RVX000222, ARV825, BIC1, ZEN-3694, BET-IN-6, BET-BAY 002 (S enantiomer), BET-BAY 002, BET bromodomain inhibitor 1, BET-IN-1, BET-IN-2, BET bromodomain inhibitor, ODM-207, BETd-246, BETd-260, I-BET151 dihydrochloride, NVS-BET-1, I-BET567, Molibresib besylate, I-BET282, I-BET282E, Molibresib, HDAC/BET-IN-1, I-BET762 carboxylic acid, GSK040, GSK1324726A, OXFBD04, (S)-GNE-987, Amredobresib, INCB054329 Racemate, INCB-057643, CF53, Desmethyl-QCA276, (+)-JQ1 PA, Bromodomain inhibitor-8, NE02734, CD235, (Rac)-BAY1238097, GSK778, PFI-1, (S)-JQ-35, GSK852, CPI-203, Trotabresib, HJB97, Y06036, PNZ5, Y06137, (+)-JQ-1-aldehyde, BRD4 D1-IN-1, BRD4 D1-IN-2, GS-626510, (+)-JQ-1, BY27, BMS-986158, AZD5153 6-Hydroxy-2-naphthoic acid, GSK097, BI-9564, MS645, CD161, ZEN-3862, MS417, (R)-BAY1238097, PLX51107, GSK620, LT052, NHWD-870, SNIPER (BRD)-1, ARV-771, ZEN-3411, ZEN-3219, RVX-297, MS402, and GSK973.

In some embodiments of any of the aspects, the method of treatment described herein further comprises administering a PROTAC degrader. In some embodiments of any of the aspects, described herein is the combination of a) an exosome, inhibitor, and/or agonist and b) a PROTAC degrader, for use in treating cancer. Proteolysis Targeting Chimeric (PROTAC) technology is an endogenous protein degradation tool that utilizes ubiquitin and targets tumor proteins by using the ubiquitin-proteosome system (UPS) to ubiquitinate and degrade tumor proteins, achieving an effect on tumor growth. Through the use of a heterobifunctional small molecule consisting of two ligands joined by a linker, one ligand recruits and binds to the tumor protein of interest (POI) while the other recruits and binds and E3 ubiquitin ligase. This results in the tumor POI's subsequent degradation through the UPS and the PROTAC is recycled to target another tumor POI. Examples of PROTAC degraders include but are not limited to: ARV-110, ARV-471, dBET1, DT-6, CP-10, C3, C5, Compounds 6A-D, SD-36, BETd-260, PROTAC7, CP5V, ARD-61, ARD-266, Compound I-6, Compound 3, SIAIS178, UNC6852, A1874, Compounds 4, β-NF-ATRA, β-NF-JQ1, KT-474, NX-2127, DT2216, METAP2, AC682, ARV-766, CC-94676, FHD-609, KT-413, KT-333, NX-5948, CFT8634, CFT8919, CG001419, CC-220, CC-92480, CC-90009, CC-99282, CFT7455, DKY709, VZ185, MZ1, ARV-825, dBET6, dBET1, ARV-771, AU-15330, PROTAC CBP/P300 Degrader-1, dBET23, LC-2, ACBI1, Gefitinib-based PROTAC 3, BSJ-03-123, SD-36, MD-224, THAL-SNS-032, BETd-260, BRD4 degrader AT1, dTRIM24, BSJ-4-116, dBET57, ARCC-4, MT-802, UNC6852, SJF620, ZXH-3-26, A1874, PROTAC FAK degrader 1, CP-10, BSJ-03-204, XZ739, PROTAC Mcl1 degrader-1, GNE-987, MS4078, ARD-266, PROTAC SGK3 degrader-1, dCBP-1, PROTAC RIPK degrader-2, FKBP12 PROTAC RC32, dFKBP-1, BI-3663, PROTAC FLT-3 degrader 1, PROTAC Bcl2 degrader-1, PROTAC CDK9 Degrader-1, PROTAC B-Raf degrader 1, FKBP12 PROTAC dTAG-13, TL12-186, PROTAC Sirt2 Degrader-1, BSJ-04-132, PROTAC RIPK degrader-6, PROTAC BRD9 Degrader-1, JH-XI-10-02, ERD-308, Homo-PROTAC pVHL30 degrader 1, PROTAC CDK2/9 Degrader-1, SIAIS178, XY028-140, MZP-55, PROTAC ERα Degrader-2, GMB-475, BETd-246, MZP-54, PROTAC IRAK4 degrader-1, PROTAC CRBN Degrader-1, PROTAC FKBP Degrader-3, KB02-JQ1, MS4077, PROTAC AR Degrader-4 TFA, PROTAC MDM2 Degrader-3, PROTAC ERα Degrader-1, PROTAC BET Degrader-1, Homo-PROTAC cereblon degrader 1, SJF620 hydrochloride, PROTAC BET Degrader-10, PROTAC EED degrader-2, JB170, CP5V, KB02-SLF, XY028-133, PROTAC BET degrader-2, PROTAC RAR Degrader-1, QCA570, PROTAC BET degrader-3, PROTAC EED degrader-1, AT6, MS432, PROTAC BRD4 Degrader-5, MD-222, PROTAC BRD4 Degrader-8, TD-165, PROTAC MDM2 Degrader-1, ARD-2585, PROTAC KRAS G12C degrader-1, PROTAC ERRα Degrader-3, SIM1, PROTAC BRD4 Degrader-9, PROTAC PD-1/PD-L1 degrader-1, AGB1, PROTAC-O4I2, PROTAC IDO1 Degrader-1, PROTAC ER Degrader-4, ARD-2128, PROTAC AR Degrader-4, FKBP12 PROTAC dTAG-7, PROTAC PARP1 degrader, ZXH-4-130 TFA, PZ703b, PROTAC BRD4 Degrader-2, PROTAC BRD4 Degrader-1, PROTAC ERRα Degrader-2, MS67, PROTAC CRABP-II Degrader-2, PROTAC BRD4 Degrader-7, PROTAC BRD2/BRD4 degrader-1, PROTAC Bcl-xL degrader-3, PROTAC BRD4 Degrader-11, XY-06-007, SJFδ, PROTAC BRD4 Degrader-12, dTAGV-1 TFA, SHP2-D26, MS4322, TL13-12, PROTAC MDM2 Degrader-4, PROTAC Bcl-xL degrader-2, PROTAC ER Degrader-3, PROTAC CRABP-II Degrader-3, GSK215, PROTAC BRD9 Degrader-4, PROTAC BRD4 Degrader-14, PROTAC BRD4 Degrader-10, OARV-771, PROTAC CRABP-II Degrader-1, PROTAC ERRα Degrader-1, PROTAC Bcl-xL degrader-1, (S)-GNE-987, CRBN-6-5-5-VHL, CCT367766, PROTAC MDM2 Degrader-2, CFT-2718, TD-428, PROTAC BRD4 Degrader-3, Thalidomide-NH-CBP/p300 ligand 2, dMCL1-2, SJFα, MS170, PROTAC BRD4 Degrader-13, PROTAC ER Degrader-10, TL13-112, PROTAC IRAK4 degrader-3, INY-03-041, PROTAC ER Degrader-2, DP-C-4, RIP2 Kinase Inhibitor 4, SJ10542, MS98, PhosTAC7, PROTAC BRD9 Degrader-2, PROTAC IRAK4 degrader-5, MS33, PROTAC CDK9 degrader-2, MS21, Dovitinib-RIBOTAC, SHP2 protein degrader-1, ZXH-4-130, PROTAC IRAK3 degrade-1, MS83, PROTAC IRAK4 degrader-4, Folate-MS432, PROTAC BRD4 Degrader-15, PROTAC BRD9 Degrader-3, PROTAC IRAK4 degrader-6, PROTAC CDK9 degrader-4, Pomalidomide-C5-Dovitinib, ARD-61, ZXH-4-137, CMP98, di-Ellipticine-RIBOTAC, CC-885-CH2-PEG1-NH-CH3, SJ995973, HDAC6 degrader-1.

In certain embodiments, an effective dose of a composition or combination as described herein can be administered to a patient once. In certain embodiments, an effective dose of a composition or combination as described herein can be administered to a patient repeatedly. For systemic administration, subjects can be administered a therapeutic amount of a composition or combination as described herein, such as, e.g. 0.1 mg/kg, 0.5 mg/kg, 1.0 mg/kg, 2.0 mg/kg, 2.5 mg/kg, 5 mg/kg, 10 mg/kg, 15 mg/kg, 20 mg/kg, 25 mg/kg, 30 mg/kg, 40 mg/kg, 50 mg/kg, or more.

In some embodiments, after an initial treatment regimen, the treatments can be administered on a less frequent basis. For example, after treatment biweekly for three months, treatment can be repeated once per month, for six months or a year or longer. Treatment according to the methods described herein can reduce levels of a marker or symptom of a condition, e.g. tumor size or growth, or EMT rate or prevalence by at least 10%, at least 15%, at least 20%, at least 25%, at least 30%, at least 40%, at least 50%, at least 60%, at least 70%, at least 80% or at least 90% or more.

The dosage of a composition as described herein can be determined by a physician and adjusted, as necessary, to suit observed effects of the treatment. With respect to duration and frequency of treatment, it is typical for skilled clinicians to monitor subjects in order to determine when the treatment is providing therapeutic benefit, and to determine whether to increase or decrease dosage, increase or decrease administration frequency, discontinue treatment, resume treatment, or make other alterations to the treatment regimen. The dosing schedule can vary from once a week to daily depending on a number of clinical factors, such as the subject's sensitivity to the active ingredient(s). The desired dose or amount of activation can be administered at one time or divided into subdoses, e.g., 2-4 subdoses and administered over a period of time, e.g., at appropriate intervals through the day or other appropriate schedule. In some embodiments, administration can be chronic, e.g., one or more doses and/or treatments daily over a period of weeks or months. Examples of dosing and/or treatment schedules are administration daily, twice daily, three times daily or four or more times daily over a period of 1 week, 2 weeks, 3 weeks, 4 weeks, 1 month, 2 months, 3 months, 4 months, 5 months, or 6 months, or more. A composition or combination as described herein can be administered over a period of time, such as over a 5 minute, 10 minute, 15 minute, 20 minute, or 25 minute period.

The dosage ranges for the administration of a composition or combination as described herein, according to the methods described herein depend upon, for example, the form of the composition or combination as described herein, its potency, and the extent to which symptoms, markers, or indicators of a condition described herein are desired to be reduced, for example the percentage reduction desired for tumor size, tumor growth, or EMT rate or prevelance. The dosage should not be so large as to cause adverse side effects. Generally, the dosage will vary with the age, condition, and sex of the patient and can be determined by one of skill in the art. The dosage can also be adjusted by the individual physician in the event of any complication.

The efficacy of composition or combination as described herein in, e.g. the treatment of a condition described herein, or to induce a response as described herein can be determined by the skilled clinician. However, a treatment is considered "effective treatment," as the term is used herein, if one or more of the signs or symptoms of a condition described herein are altered in a beneficial manner, other clinically accepted symptoms are improved, or even ameliorated, or a desired response is induced e.g., by at least 10% following treatment according to the methods described herein. Efficacy can be assessed, for example, by measuring a marker, indicator, symptom, and/or the incidence of a condition treated according to the methods described herein or any other measurable parameter appropriate, e.g. EMT marker genes. Efficacy can also be measured by a failure of an individual to worsen as assessed by hospitalization, or need for medical interventions (i.e., progression of the disease is halted). Methods of measuring these indicators are known to those of skill in the art and/or are described herein. Treatment includes any treatment of a disease in an individual or an animal (some non-limiting examples include a human or an animal) and includes: (1) inhibiting the disease, e.g., preventing a worsening of symptoms (e.g. pain or inflammation); or (2) relieving the severity of the disease, e.g., causing regression of symptoms. An effective amount for the treatment of a disease means that amount which, when administered to a subject in need thereof, is sufficient to result in effective treatment as that term is defined herein, for that disease. Efficacy of an agent can be determined by assessing physical indicators of a condition or desired response, e.g., tumor size, tumor growth, or EMT rate or prevelance. It is well within the ability of one skilled in the art to monitor efficacy of administration and/or treatment by measuring any one of such parameters, or any combination of parameters. Efficacy can be assessed in animal models of a condition described herein, for example treatment of cancer. When using an experimental animal model, efficacy of treatment is evidenced when a statistically significant change in a marker is observed, e.g. EMT marker genes described elsewhere herein.

In one respect, the present invention relates to the herein described compositions, methods, and respective component(s) thereof, as essential to the technology, yet open to the inclusion of unspecified elements, essential or not ("comprising). In some embodiments of any of the aspects, other elements to be included in the description of the composition, method or respective component thereof are limited to those that do not materially affect the basic and novel characteristic(s) of the technology (e.g., the composition, method, or respective component thereof "consists essentially of" the elements described herein). This applies equally to steps within a described method as well as compositions and components therein. In other embodiments of any of the aspects, the compositions, methods, and respective components thereof, described herein are intended to be exclusive of any element not deemed an essential element to the component, composition or method (e.g., the composition, method, or respective component thereof "consists of" the elements described herein). This applies equally to steps within a described method as well as compositions and components therein.

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed invention, because the scope of the invention is limited only by the claims. Unless otherwise defined, all technical and scientific terms used herein have the same meaning as commonly understood by one of ordinary skill in the art to which this invention belongs. If there is an apparent discrepancy between the usage of a term in the art and its definition provided herein, the definition provided within the specification shall prevail.

For convenience, certain terms employed herein, in the specification, examples and appended claims are collected here.

The terms "decrease", "reduced", "reduction", or "inhibit" are all used herein to mean a decrease by a statistically significant amount. In some embodiments, "reduce," "reduction" or "decrease" or "inhibit" typically means a decrease by at least 10% as compared to a reference level (e.g. the absence of a given treatment or agent) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more. As used herein, "reduction" or "inhibition" does not encompass a complete inhibition or reduction as compared to a reference level. "Complete inhibition" is a 100% inhibition as compared to a reference level. A decrease can be preferably down to a level accepted as within the range of normal for an individual without a given disorder.

The terms "increased", "increase", "enhance", or "activate" are all used herein to mean an increase by a statically significant amount. In some embodiments, the terms "increased", "increase", "enhance", or "activate" can mean an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level. In the context of a marker or symptom, a "increase" is a statistically significant increase in such level.

In some embodiments of any of the aspects, an increased level of expression, e.g., one which indicates a patient is high or increased risk or is in need of a treatment as described herein is 1.25 fold or greater change relative to a reference. In some embodiments of any of the aspects, an increased level of expression, e.g., one which indicates a patient is high or increased risk or is in need of a treatment as described herein is 2.5 fold or greater change relative to a reference.

As used herein, a "subject" means a human or animal. Usually the animal is a vertebrate such as a primate, rodent, domestic animal or game animal. Primates include chimpanzees, cynomologus monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. In some embodiments, the subject is a mammal, e.g., a primate, e.g., a human. The terms, "individual," "patient" and "subject" are used interchangeably herein.

Preferably, the subject is a mammal. The mammal can be a human, non-human primate, mouse, rat, dog, cat, horse, or cow, but is not limited to these examples. Mammals other than humans can be advantageously used as subjects that represent animal models of cancer. A subject can be male or female.

A subject can be one who has been previously diagnosed with or identified as suffering from or having a condition in need of treatment (e.g. cancer) or one or more complications related to such a condition, and optionally, have already undergone treatment for the condition or the one or more complications related to the condition. Alternatively, a subject can also be one who has not been previously diagnosed as having the condition or one or more complications related to the condition. For example, a subject can be one who exhibits one or more risk factors for the condition or one or more complications related to the condition or a subject who does not exhibit risk factors.

A "subject in need" of treatment for a particular condition can be a subject having that condition, diagnosed as having that condition, or at risk of developing that condition.

As used herein, the terms "protein" and "polypeptide" are used interchangeably herein to designate a series of amino acid residues, connected to each other by peptide bonds between the alpha-amino and carboxy groups of adjacent residues. The terms "protein", and "polypeptide" refer to a polymer of amino acids, including modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein" and "polypeptide" are used interchangeably herein when referring to a gene product and fragments thereof. Thus, exemplary polypeptides or proteins include gene products, naturally occurring proteins, homologs, orthologs, paralogs, fragments and other equivalents, variants, fragments, and analogs of the foregoing. The terms also refer to fragments or variants of the polypeptide that maintain at least 50% of the activity or effect of the full length reference polypeptide. Conservative substitution variants that maintain the activity of a wildtype protein will include a conservative substitution as defined herein. The identification of amino acids most likely to be tolerant of conservative substitution while maintaining at least 50% of the activity of the wildtype is guided by, for example, sequence alignment with homologs or paralogs from other species. Amino acids that are identical between homologs are less likely to tolerate change, while those showing conservative differences are obviously much more likely to tolerate conservative change in the context of an artificial variant. Similarly, positions with non-conservative differences are less likely to be critical to function and more likely to tolerate conservative substitution in an artificial variant. Variants, fragments, and/or fusion proteins can be tested for activity, for example, by administering the variant to an appropriate animal model of cancer as described herein.

In some embodiments, a polypeptide can be a variant of a sequence described herein. In some embodiments, the variant is a conservative substitution variant. Variants can be obtained by mutations of native nucleotide sequences, for example. A "variant," as referred to herein, is a polypeptide substantially homologous to a native or reference polypeptide, but which has an amino acid sequence different from that of the native or reference polypeptide because of one or a plurality of deletions, insertions or substitutions. Polypeptide-encoding DNA sequences encompass sequences that comprise one or more additions, deletions, or substitutions of nucleotides when compared to a native or reference DNA sequence, but that encode a variant protein or fragment thereof that retains the relevant biological activity relative to the reference protein, e.g., at least 50% of that displayed by the wildtype. As to amino acid sequences, one of skill will recognize that individual substitutions, deletions or additions to a nucleic acid, peptide, polypeptide, or protein sequence which alters a single amino acid or a small percentage, (i.e. 5% or fewer, e.g. 4% or fewer, or 3% or fewer, or 1% or fewer) of amino acids in the encoded sequence is a "conservatively modified variant" where the alteration results in the substitution of an amino acid with a chemically similar amino acid. It is contemplated that some changes can potentially improve the relevant activity, such that a variant, whether conservative or not, has more than 100% of the activity of a wildtype protein, e.g. 110%, 125%, 150%, 175%, 200%, 500%, 1000% or more.

One method of identifying amino acid residues which can be substituted is to align, for example, a human protein to a homolog from one or more non-human species. Alignment can provide guidance regarding not only residues likely to be necessary for function but also, conversely, those residues likely to tolerate change. Where, for example, an alignment shows two identical or similar amino acids at corresponding positions, it is more likely that that site is important functionally. Where, conversely, alignment shows residues in corresponding positions to differ significantly in size, charge, hydrophobicity, etc., it is more likely that that site can tolerate variation in a functional polypeptide. The variant amino acid or DNA sequence can be at least 90%, at least 95%, at least 96%, at least 97%, at least 98%, at least 99%, or more, identical to a native or reference sequence, or a nucleic acid encoding one of those amino acid sequences. The degree of homology (percent identity) between a native and a mutant sequence can be determined, for example, by comparing the two sequences using freely available computer programs commonly employed for this purpose on the world wide web. The variant amino acid or DNA sequence can be at least 90%, at least 91%, at least 92%, at least 93%, at least 94%, at least 95%, at least 96%, at least 97%, at least 98%, at least 99%, or more, similar to the sequence from which it is derived (referred to herein as an "original" sequence). The degree of similarity (percent similarity) between an original and a mutant sequence can be determined, for example, by using a similarity matrix. Similarity matrices are well known in the art and a number of tools for comparing two sequences using similarity matrices are freely available online, e.g. BLASTp or BLASTn (available on the world wide web at blast.ncbi.nlm.nih.gov), with default parameters set.

In the various embodiments described herein, it is further contemplated that variants (naturally occurring or otherwise), alleles, homologs, conservatively modified variants, and/or conservative substitution variants of any of the particular polypeptides described are encompassed. As to amino acid sequences, one of skill will recognize that individual substitutions, deletions or additions to a nucleic acid, peptide, polypeptide, or protein sequence which alters a single amino acid or a small percentage of amino acids in the encoded sequence is a "conservatively modified variant" where the alteration results in the substitution of an amino acid with a chemically similar amino acid and retains the desired activity of the polypeptide. Such conservatively modified variants are in addition to and do not exclude polymorphic variants, interspecies homologs, and alleles consistent with the disclosure.

A given amino acid can be replaced by a residue having similar physiochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity and specificity of a native or reference polypeptide is retained.

A given amino acid can be replaced by a residue having similar physiochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity of a native or reference polypeptide is retained. Conservative substitution tables providing functionally similar amino acids are well known in the art. Such conservatively modified variants are in addition to and do not exclude polymorphic variants, interspecies homologs, and alleles consistent with the disclosure.

Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions will entail exchanging a member of one of these classes for another class. Particular conservative substitutions include, for example; Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu. Typically conservative substitutions for one another also include: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)).

In some embodiments, the polypeptide described herein (or a nucleic acid encoding such a polypeptide) can be a functional fragment of one of the amino acid sequences described herein. As used herein, a "functional fragment" is a fragment or segment of a peptide which retains at least 50% of the wildtype reference polypeptide's activity according to the assays described below herein. A functional fragment can comprise conservative substitutions of the sequences disclosed herein.

In some embodiments, the polypeptide described herein can be a variant of a sequence described herein. In some embodiments, the variant is a conservatively modified variant. Conservative substitution variants can be obtained by mutations of native nucleotide sequences, for example. A "variant," as referred to herein, is a polypeptide substantially homologous to a native or reference polypeptide, but which has an amino acid sequence different from that of the native or reference polypeptide because of one or a plurality of deletions, insertions or substitutions. Variant polypeptide-encoding DNA sequences encompass sequences that comprise one or more additions, deletions, or substitutions of nucleotides when compared to a native or reference DNA sequence, but that encode a variant protein or fragment thereof that retains activity. A wide variety of PCR-based site-specific mutagenesis approaches are known in the art and can be applied by the ordinarily skilled artisan.

In some embodiments, a polypeptide, e can comprise one or more amino acid substitutions or modifications. In some embodiments, the substitutions and/or modifications can prevent or reduce proteolytic degradation and/or prolong half-life of the polypeptide in a subject. In some embodiments, a polypeptide can be modified by conjugating or fusing it to other polypeptide or polypeptide domains such as, by way of non-limiting example, transferrin (WO06096515A2), albumin (Yeh et al., 1992), growth hormone (US2003104578AA); cellulose (Levy and Shoseyov, 2002); and/or Fc fragments (Ashkenazi and Chamow, 1997). The references in the foregoing paragraph are incorporated by reference herein in their entireties.

In some embodiments, a polypeptide as described herein can comprise at least one peptide bond replacement. A polypeptide as described herein can comprise one type of peptide bond replacement or multiple types of peptide bond replacements, e.g. 2 types, 3 types, 4 types, 5 types, or more types of peptide bond replacements. Non-limiting examples of peptide bond replacements include urea, thiourea, carbamate, sulfonyl urea, trifluoroethylamine, ortho-(aminoalkyl)-phenylacetic acid, para-(aminoalkyl)-phenylacetic acid, meta-(aminoalkyl)-phenylacetic acid, thioamide, tetrazole, boronic ester, olefinic group, and derivatives thereof.

In some embodiments, a polypeptide as described herein can comprise naturally occurring amino acids commonly found in polypeptides and/or proteins produced by living organisms, e.g. Ala (A), Val (V), Leu (L), Ile (I), Pro (P), Phe (F), Trp (W), Met (M), Gly (G), Ser (S), Thr (T), Cys (C), Tyr (Y), Asn (N), Gln (Q), Asp (D), Glu (E), Lys (K), Arg (R), and His (H). In some embodiments, a polypeptide as described herein can comprise alternative amino acids. Non-limiting examples of alternative amino acids include, D-amino acids; beta-amino acids; homocysteine, phosphoserine, phosphothreonine, phosphotyrosine, hydroxyproline, gamma-carboxyglutamate; hippuric acid, octahydroindole-2-carboxylic acid, statine, 1,2,3,4-tetrahydroisoquinoline-3-carboxylic acid, penicillamine (3-mercapto-D-valine), ornithine, citruline, alpha-methyl-alanine, para-benzoylphenylalanine, para-amino phenylalanine, p-fluorophenylalanine, phenylglycine, propargylglycine, sarcosine, and tert-butylglycine), diaminobutyric acid, 7-hydroxy-tetrahydroisoquinoline carboxylic acid, naphthylalanine, biphenylalanine, cyclohexylalanine, amino-isobutyric acid, norvaline, norleucine, tert-leucine, tetrahydroisoquinoline carboxylic acid, pipecolic acid, phenylglycine, homophenylalanine, cyclohexylglycine, dehydroleucine, 2,2-diethylglycine, 1-amino-1-cyclopentanecarboxylic acid, 1-amino-1-cyclohexanecarboxylic acid, amino-benzoic acid, amino-naphthoic acid, gamma-aminobutyric acid, difluorophenylalanine, nipecotic acid, alpha-amino butyric acid, thienyl-alanine, t-butylglycine, trifluorovaline; hexafluoroleucine; fluorinated analogs; azide-modified amino acids; alkyne-modified amino acids; cyano-modified amino acids; and derivatives thereof.

In some embodiments, a polypeptide can be modified, e.g. by addition of a moiety to one or more of the amino acids that together comprise the peptide. In some embodiments, a polypeptide as described herein can comprise one or more moiety molecules, e.g. 1 or more moiety molecules per polypeptide, 2 or more moiety molecules per polypeptide, 5 or more moiety molecules per polypeptide, 10 or more moiety molecules per polypeptide or more moiety molecules per polypeptide. In some embodiments, a polypeptide as described herein can comprise one more types of modifications and/or moieties, e.g. 1 type of modification, 2 types of modifications, 3 types of modifications or more types of modifications. Non-limiting examples of modifications and/or moieties include PEGylation; glycosylation; HESylation; ELPylation; lipidation; acetylation; amidation; end-capping modifications; cyano groups; phosphorylation; albumin, and cyclization. In some embodiments, an end-capping modification can comprise acetylation at the N-terminus, N-terminal acylation, and N-terminal formylation. In some embodiments, an end-capping modification can comprise amidation at the C-terminus, introduction of C-terminal alcohol, aldehyde, ester, and thioester moieties. The half-life of a polypeptide can be increased by the addition of moieties, e.g. PEG, albumin, or other fusion partners (e.g. Fc fragment of an immunoglobin).

Any cysteine residue not involved in maintaining the proper conformation of the polypeptide also can be substituted, generally with serine, to improve the oxidative stability of the molecule and prevent aberrant crosslinking. Conversely, cysteine bond(s) can be added to the polypeptide to improve its stability or facilitate oligomerization.

Alterations of the native amino acid sequence can be accomplished by any of a number of techniques known to one of skill in the art. Mutations can be introduced, for example, at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations are very well established. Alterations of the original amino acid sequence can be accomplished by any of a number of techniques known to one of skill in the art. Mutations can be introduced, for example, at particular loci by synthesizing oligonucleotides containing a mutant sequence, flanked by restriction sites permitting ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations include those disclosed by Khudyakov et al. "Artificial DNA: Methods and Applications" CRC Press, 2002; Braman "In Vitro Mutagenesis Protocols" Springer, 2004; and Rapley "The Nucleic Acid Protocols Handbook" Springer 2000; which are herein incorporated by reference in their entireties. In some embodiments, a polypeptide as described herein can be chemically synthesized and mutations can be incorporated as part of the chemical synthesis process.

As used herein, the term "nucleic acid" or "nucleic acid sequence" refers to any molecule, preferably a polymeric molecule, incorporating units of ribonucleic acid, deoxyribonucleic acid or an analog thereof. The nucleic acid can be either single-stranded or double-stranded. A single-stranded nucleic acid can be one nucleic acid strand of a denatured double-stranded DNA. Alternatively, it can be a single-stranded nucleic acid not derived from any double-stranded DNA. In one aspect, the nucleic acid can be DNA. In another aspect, the nucleic acid can be RNA. Suitable DNA can include, e.g., genomic DNA or cDNA. Suitable RNA can include, e.g., mRNA.

The term "expression" refers to the cellular processes involved in producing RNA and proteins and as appropriate, secreting proteins, including where applicable, but not limited to, for example, transcription, transcript processing, translation and protein folding, modification and processing. Expression can refer to the transcription and stable accumulation of sense (mRNA) or antisense RNA derived from a nucleic acid fragment or fragments of the invention and/or to the translation of mRNA into a polypeptide.

In some embodiments, the expression of a biomarker(s), target(s), or gene/polypeptide described herein is/are tissue-specific. In some embodiments, the expression of a biomarker(s), target(s), or gene/polypeptide described herein is/are global. In some embodiments, the expression of a biomarker(s), target(s), or gene/polypeptide described herein is systemic.

"Expression products" include RNA transcribed from a gene, and polypeptides obtained by translation of mRNA transcribed from a gene. The term "gene" means the nucleic acid sequence which is transcribed (DNA) to RNA in vitro or in vivo when operably linked to appropriate regulatory sequences. The gene may or may not include regions preceding and following the coding region, e.g. 5' untranslated (5'UTR) or "leader" sequences and 3' UTR or "trailer" sequences, as well as intervening sequences (introns) between individual coding segments (exons).

"Operably linked" refers to an arrangement of elements wherein the components so described are configured so as to perform their usual function. Thus, control elements operably linked to a coding sequence are capable of effecting the expression of the coding sequence. The control elements need not be contiguous with the coding sequence, so long as they function to direct the expression thereof. Thus, for example, intervening untranslated yet transcribed sequences can be present between a promoter sequence and the coding sequence and the promoter sequence can still be considered "operably linked" to the coding sequence.

"Marker" in the context of the present invention refers to an expression product, e.g., nucleic acid or polypeptide which is differentially present in a sample taken from subjects having having diabetes or cancer, as compared to a comparable sample taken from control subjects (e.g., a healthy subject). The term "biomarker" is used interchangeably with the term "marker."

In some embodiments, the methods described herein relate to measuring, detecting, or determining the level of at least one marker. As used herein, the term "detecting" or "measuring" refers to observing a signal from, e.g. a probe, label, or target molecule to indicate the presence of an analyte in a sample. Any method known in the art for detecting a particular label moiety can be used for detection. Exemplary detection methods include, but are not limited to, spectroscopic, fluorescent, photochemical, biochemical, immunochemical, electrical, optical or chemical methods. In some embodiments of any of the aspects, measuring can be a quantitative observation.

In some embodiments of any of the aspects, a polypeptide, nucleic acid, or cell as described herein can be engineered. As used herein, "engineered" refers to the aspect of having been manipulated by the hand of man. For example, a polypeptide is considered to be "engineered" when at least one aspect of the polypeptide, e.g., its sequence, has been manipulated by the hand of man to differ from the aspect as it exists in nature. As is common practice and is understood by those in the art, progeny of an engineered cell are typically still referred to as "engineered" even though the actual manipulation was performed on a prior entity.

In some embodiments of any of the aspects, the inhibitor, agonist, or exosome administered to a subject as described herein is exogenous. In some embodiments of any of the aspects, the inhibitor, agonist, or exosome administered to a subject as described herein is ectopic. In some embodiments of any of the aspects, the inhibitor, agonist, or exosome administered to a subject as described herein is not endogenous.

The term "exogenous" refers to a substance present in a cell other than its native source. The term "exogenous" when used herein can refer to a nucleic acid (e.g. a nucleic acid encoding a polypeptide) or a polypeptide that has been introduced by a process involving the hand of man into a biological system such as a cell or organism in which it is not normally found and one wishes to introduce the nucleic acid or polypeptide into such a cell or organism. Alternatively, "exogenous" can refer to a nucleic acid or a polypeptide that has been introduced by a process involving the hand of man into a biological system such as a cell or organism in which it is found in relatively low amounts and one wishes to increase the amount of the nucleic acid or polypeptide in the cell or organism, e.g., to create ectopic expression or levels. In contrast, the term "endogenous" refers to a substance that is native to the biological system or cell. As used herein, "ectopic" refers to a substance that is found in an unusual location and/or amount. An ectopic substance can be one that is normally found in a given cell, but at a much lower amount and/or at a different time. Ectopic also includes substance, such as a polypeptide or nucleic acid that is not naturally found or expressed in a given cell in its natural environment.

In some embodiments, a nucleic acid encoding a polypeptide as described herein (e.g. an agonist polypeptide) is comprised by a vector. In some of the aspects described herein, a nucleic acid sequence encoding a given polypeptide as described herein, or any module thereof, is operably linked to a vector. The term "vector", as used herein, refers to a nucleic acid construct designed for delivery to a host cell or for transfer between different host cells. As used herein, a vector can be viral or non-viral. The term "vector" encompasses any genetic element that is capable of replication when associated with the proper control elements and that can transfer gene sequences to cells. A vector can include, but is not limited to, a cloning vector, an expression vector, a plasmid, phage, transposon, cosmid, chromosome, virus, virion, etc.

In some embodiments of any of the aspects, the vector is recombinant, e.g., it comprises sequences originating from at least two different sources. In some embodiments of any of the aspects, the vector comprises sequences originating from at least two different species. In some embodiments of any of the aspects, the vector comprises sequences originating from at least two different genes, e.g., it comprises a fusion protein or a nucleic acid encoding an expression product which is operably linked to at least one non-native (e.g., heterologous) genetic control element (e.g., a promoter, suppressor, activator, enhancer, response element, or the like).

In some embodiments of any of the aspects, the vector or nucleic acid described herein is codon-optomized, e.g., the native or wild-type sequence of the nucleic acid sequence has been altered or engineered to include alternative codons such that altered or engineered nucleic acid encodes the same polypeptide expression product as the native/wild-type sequence, but will be transcribed and/or translated at an improved efficiency in a desired expression system. In some embodiments of any of the aspects, the expression system is an organism other than the source of the native/wild-type sequence (or a cell obtained from such organism). In some embodiments of any of the aspects, the vector and/or nucleic acid sequence described herein is codon-optimized for expression in a mammal or mammalian cell, e.g., a mouse, a murine cell, or a human cell. In some embodiments of any of the aspects, the vector and/or nucleic acid sequence described herein is codon-optimized for expression in a human cell. In some embodiments of any of the aspects, the vector and/or nucleic acid sequence described herein is codon-optimized for expression in a yeast or yeast cell. In some embodiments of any of the aspects, the vector and/or nucleic acid sequence described herein is codon-optimized for expression in a bacterial cell. In some embodiments of any of the aspects, the vector and/or nucleic acid sequence described herein is codon-optimized for expression in an *E. coli* cell.

As used herein, the term "expression vector" refers to a vector that directs expression of an RNA or polypeptide from sequences linked to transcriptional regulatory sequences on the vector. The sequences expressed will often, but not necessarily, be heterologous to the cell. An expression vector may comprise additional elements, for example, the expression vector may have two replication systems, thus allowing it to be maintained in two organisms, for example in human cells for expression and in a prokaryotic host for cloning and amplification.

As used herein, the term "viral vector" refers to a nucleic acid vector construct that includes at least one element of viral origin and has the capacity to be packaged into a viral vector particle. The viral vector can contain the nucleic acid encoding a polypeptide as described herein in place of non-essential viral genes. The vector and/or particle may be utilized for the purpose of transferring any nucleic acids into cells either in vitro or in vivo. Numerous forms of viral vectors are known in the art.

It should be understood that the vectors described herein can, in some embodiments, be combined with other suitable compositions and therapies. In some embodiments, the vector is episomal. The use of a suitable episomal vector provides a means of maintaining the nucleotide of interest in the subject in high copy number extra chromosomal DNA thereby eliminating potential effects of chromosomal integration.

As used herein, the terms "treat," "treatment," "treating," or "amelioration" refer to therapeutic treatments, wherein the object is to reverse, alleviate, ameliorate, inhibit, slow down or stop the progression or severity of a condition associated with a disease or disorder, e.g. cancer. The term "treating" includes reducing or alleviating at least one adverse effect or symptom of a condition, disease or disorder associated with a cancer. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment).

In some embodiments of any of the aspects, described herein is a prophylactic method of treatment. As used herein "prophylactic" refers to the timing and intent of a treatment relative to a disease or symptom, that is, the treatment is administered prior to clinical detection or diagnosis of that particular disease or symptom in order to protect the patient from the disease or symptom. Prophylactic treatment can encompass a reduction in the severity or speed of onset of the disease or symptom, or contribute to faster recovery from the disease or symptom. Accordingly, the methods described herein can be prophylactic relative to metastasis or tumor formation. In some embodiments of any of the aspects, prophylactic treatment is not prevention of all symptoms or signs of a disease.

As used herein, the term "pharmaceutical composition" refers to the active agent in combination with a pharmaceutically acceptable carrier e.g. a carrier commonly used in the pharmaceutical industry. The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. In some embodiments of any of the aspects, a pharmaceutically acceptable carrier can be a carrier other than water. In some embodiments of any of the aspects, a pharmaceutically acceptable carrier can be a cream, emulsion, gel, liposome, nanoparticle, and/or ointment. In some embodiments of any of the aspects, a pharmaceutically acceptable carrier can be an artificial or engineered carrier, e.g., a carrier that the active ingredient would not be found to occur in in nature.

As used herein "combination" refers to a group of two or more substances for use together, e.g., for administration to the same subject. The two or more substances can be present in the same formulation in any molecular or physical arrangement, e.g, in an admixture, in a solution, in a mixture, in a suspension, in a colloid, in an emulsion. The formulation can be a homogeneous or heterogenous mixture. In some embodiments of any of the aspects, the two or more substances active compound(s) can be comprised by the same or different superstructures, e.g., nanoparticles, liposomes, vectors, cells, scaffolds, or the like, and said superstructure is in solution, mixture, admixture, suspension with a solvent, carrier, or some of the two or more substances. Alternatively, the two or more substances can be present in two or more separate formulations, e.g., in a kit or package comprising multiple formulations in separate containers, to be administered to the same subject.

A kit is an assemblage of materials or components, including at least one reagent described herein. The exact nature of the components configured in the kit depends on its intended purpose. In some embodiments of any of the aspects, a kit includes instructions for use. "Instructions for use" typically include a tangible expression describing the technique to be employed in using the components of the kit, e.g., to treat a subject or for administration to a subject. Still in accordance with the present invention, "instructions for use" may include a tangible expression describing the preparation of at least one reagent described herein, such as dilution, mixing, or incubation instructions, and the like, typically for an intended purpose. Optionally, the kit also contains other useful components, such as, measuring tools, diluents, buffers, syringes, pharmaceutically acceptable carriers, or other useful paraphernalia as will be readily recognized by those of skill in the art.

The materials or components assembled in the kit can be provided to the practitioner stored in any convenient and suitable ways that preserve their operability and utility. For example, the components can be in dissolved, dehydrated, or lyophilized form; they can be provided at room, refrigerated or frozen temperatures. The components are typically contained in suitable packaging material(s). As employed herein, the phrase "packaging material" refers to one or more physical structures used to house the contents of the kit, such as inventive compositions and the like. The packaging material is constructed by well-known methods, preferably to provide a sterile, contaminant-free environment. The packaging may also preferably provide an environment that protects from light, humidity, and oxygen. As used herein, the term "package" refers to a suitable solid matrix or material such as glass, plastic, paper, foil, polyester (such as polyethylene terephthalate, or Mylar) and the like, capable of holding the individual kit components. Thus, for example, a package can be a glass vial used to contain suitable quantities of a composition containing a volume of at least one reagent described herein. The packaging material generally has an external label which indicates the contents and/or purpose of the kit and/or its components.

As used herein, the term "nanoparticle" refers to particles that are on the order of about 1 to 1,000 nanometers in diameter or width. The term "nanoparticle" includes nanospheres; nanorods; nanoshells; and nanoprisms; these nanoparticles may be part of a nanonetwork. The term "nanoparticles" also encompasses liposomes and lipid particles having the size of a nanoparticle. Exemplary nanoparticles include lipid nanoparticles or ferritin nanoparticles. Lipid nanoparticles can comprise multiple componenents, including, e.g., ionizable lipids (such as MC3, DLin-MC3-DMA, ALC-0315, or SM-102), pegylated lipids (such as PEG2000-C-DMG, PEG2000-DMG, ALC-0159), phospholipids (such as DSPC), and cholesterol.

Exemplary liposomes can comprise, e.g., DSPC, DPPC, DSPG, Cholesterol, hydrogenated soy phosphatidylcholine, soy phosphatidyl choline, methoxypolyethylene glycol (mPEG-DSPE) phosphatidyl choline (PC), phosphatidyl glycerol (PG), distearoylphosphatidylcholine, and combinations thereof.

As used herein, the term "administering," refers to the placement of a compound as disclosed herein into a subject by a method or route which results in at least partial delivery of the agent at a desired site. Pharmaceutical compositions comprising the compounds disclosed herein can be administered by any appropriate route which results in an effective treatment in the subject. In some embodiments, administration comprises physical human activity, e.g., an injection, act of ingestion, an act of application, and/or manipulation of a delivery device or machine. Such activity can be performed, e.g., by a medical professional and/or the subject being treated.

As used herein, "contacting" refers to any suitable means for delivering, or exposing, an agent to at least one cell. Exemplary delivery methods include, but are not limited to, direct delivery to cell culture medium, perfusion, injection, or other delivery method well known to one skilled in the art. In some embodiments, contacting comprises physical human activity, e.g., an injection; an act of dispensing, mixing, and/or decanting; and/or manipulation of a delivery device or machine.

The term "statistically significant" or "significantly" refers to statistical significance and generally means a two standard deviation (2SD) or greater difference.

Other than in the operating examples, or where otherwise indicated, all numbers expressing quantities of ingredients or reaction conditions used herein should be understood as modified in all instances by the term "about." The term "about" when used in connection with percentages can mean±1%.

As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of additional elements that do not materially affect the basic and novel or functional characteristic(s) of that embodiment of the invention.

As used herein, the term "specific binding" refers to a chemical interaction between two molecules, compounds, cells and/or particles wherein the first entity binds to the second, target entity with greater specificity and affinity than it binds to a third entity which is a non-target. In some embodiments, specific binding can refer to an affinity of the first entity for the second target entity which is at least 10 times, at least 50 times, at least 100 times, at least 500 times, at least 1000 times or greater than the affinity for the third nontarget entity. A reagent specific for a given target is one that exhibits specific binding for that target under the conditions of the assay being utilized.

The singular terms "a," "an," and "the" include plural referents unless context clearly indicates otherwise. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

Groupings of alternative elements or embodiments of the invention disclosed herein are not to be construed as limitations. Each group member can be referred to and claimed individually or in any combination with other members of the group or other elements found herein. One or more members of a group can be included in, or deleted from, a group for reasons of convenience and/or patentability. When any such inclusion or deletion occurs, the specification is herein deemed to contain the group as modified thus fulfilling the written description of all Markush groups used in the appended claims.

Unless otherwise defined herein, scientific and technical terms used in connection with the present application shall have the meanings that are commonly understood by those of ordinary skill in the art to which this disclosure belongs. It should be understood that this invention is not limited to the particular methodology, protocols, and reagents, etc., described herein and as such can vary. The terminology used herein is for the purpose of describing particular embodiments only, and is not intended to limit the scope of the present invention, which is defined solely by the claims. Definitions of common terms in immunology and molecular biology can be found in The Merck Manual of Diagnosis and Therapy, 20th Edition, published by Merck Sharp & Dohme Corp., 2018 (ISBN 0911910190, 978-0911910421); Robert S. Porter et al. (eds.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), W. W. Norton & Company, 2016 (ISBN 0815345054, 978-0815345053); Lewin's Genes XI, published by Jones & Bartlett Publishers, 2014 (ISBN-1449659055); Michael Richard Green and Joseph Sambrook, Molecular Cloning: A Laboratory Manual, 4th ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.) Elsevier, 2013 (ISBN 0124199542); Current Protocols in Molecular Biology (CPMB), Frederick M. Ausubel (ed.), John Wiley and Sons, 2014 (ISBN 047150338X, 9780471503385), Current Protocols in Protein Science (CPPS), John E. Coligan (ed.), John Wiley and Sons, Inc., 2005; and Current Protocols in Immunology (CPI) (John E. Coligan, ADA M Kruisbeek, David H Margulies, Ethan M Shevach, Warren Strobe, (eds.) John Wiley and Sons, Inc., 2003 (ISBN 0471142735, 9780471142737), the contents of which are all incorporated by reference herein in their entireties.

One of skill in the art can readily identify a chemotherapeutic agent of use (e.g. see Physicians' Cancer Chemotherapy Drug Manual 2014, Edward Chu, Vincent T. DeVita Jr., Jones & Bartlett Learning; Principles of Cancer Therapy, Chapter 85 in Harrison's Principles of Internal Medicine, 18th edition; Therapeutic Targeting of Cancer Cells: Era of Molecularly Targeted Agents and Cancer Pharmacology, Chs. 28-29 in Abeloff's Clinical Oncology, 2013 Elsevier; and Fischer D S (ed): The Cancer Chemotherapy Handbook, 4th ed. St. Louis, Mosby-Year Book, 2003).

In some embodiments of any of the aspects, the disclosure described herein does not concern a process for cloning human beings, processes for modifying the germ line genetic identity of human beings, uses of human embryos for industrial or commercial purposes or processes for modifying the genetic identity of animals which are likely to cause them suffering without any substantial medical benefit to man or animal, and also animals resulting from such processes.

In all embodiments where a sample is obtained or has been obtained or provided, the sample can be sample taken, obtained, or provided via minimally invasive methods and/or involves only a minor intervention. In some embodiments of any of the aspects, a sample is taken, obtained, or provided by one or more of a blood draw or prick, an epidermal or mucus membrane swab, buccal sampling, saliva sample, a epidermal skin sampling technique, and/or collection of a secreted or expelled bodily fluid (e.g., mucus, urine, sweat, etc), fecal sampling, semen/seminal fluid sampling, or clippings (e.g., of hair or nails). In some embodiments of any of the aspects, the sample comprises, consists of, or consists essentially of blood (or any fraction or component thereof), serum, urine, mucus, epithelial cells, saliva, buccal cells, a secreted or expelled bodily fluid, and/or hair or nail clippings.

Other terms are defined herein within the description of the various aspects of the invention.

All patents and other publications; including literature references, issued patents, published patent applications, and co-pending patent applications; cited throughout this application are expressly incorporated herein by reference for the purpose of describing and disclosing, for example, the methodologies described in such publications that might be used in connection with the technology described herein. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

In some embodiments, the present technology may be defined in any of the following numbered paragraphs:

1. A method comprising:
    determining the expression of at least one gene selected from the group consisting of:
        miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d;
    in an exosome obtained from a subject.
2. The method of paragraph 1, wherein the expression of at least one gene selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined.
3. The method of paragraph 1, wherein the expression of at least one gene selected from the group consisting of: miR374a-5p, miR-93-5p, miR-28-3p, miR-let-7b-3p, and miR-375; is determined.
4. The method of paragraph 1, wherein the expression of at least two genes selected from the group consisting of: miR374a-5p, miR-93-5p, miR-28-3p, miR-let-7b-3p, and miR-375; is determined.
5. The method of paragraph 1, wherein the expression of at least three genes selected from the group consisting of: miR374a-5p, miR-93-5p, miR-28-3p, miR-let-7b-3p, and miR-375; is determined.
6. The method of paragraph 1, wherein the expression of at least four genes selected from the group consisting of: miR374a-5p, miR-93-5p, miR-28-3p, miR-let-7b-3p, and miR-375; is determined.
7. The method of paragraph 1, wherein the expression of at least miR374a-5p, miR-93-5p, miR-28-3p, miR-let-7b-3p, and miR-375; is determined.
8. The method of paragraph 1, wherein the expression of at least miR374a-5p is determined.
9. The method of any of the preceding paragraphs, wherein an increased level of expression of at least one gene selected from:
    miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or
    a decreased level of expression of at least one gene selected from:
    miR424-5p, miR-326, miR424-5p, miR-27a-3p, miR320b and miR320d;
    indicates an increased risk of cancer, metastasis, and/or EMT for the subject, wherein the level of expression is relative to the level of expression in a exosome obtained from a healthy non-diabetic subject.
10. The method of any of the preceding paragraphs, further comprising:
    a) i) administering a glucose-controlling medication or obesity medication and/or
    ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference.
11. The method of any of the preceding paragraphs, further comprising:
    a) i) administering a glucose-controlling medication or obesity medication and/or
    ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference; or
    b) i) not administering a glucose-controlling medication or obesity medication and/or
    ii) administering CT scans at a frequency of no more than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is not increased relative to a reference; or an expression level of at least one gene selected from: miR424-5p, miR-326, miR424-5p, miR-27a-3p, miR320b and miR320d; which is not decreased relative to a reference.
12. A method of treating cancer, comprising:
    a) i) administering a glucose-controlling medication or obesity medication and/or
    ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference.

13. A method of treating cancer, comprising:
  a) i) administering a glucose-controlling medication or obesity medication and/or
    ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference; or
  b) i) not administering a glucose-controlling medication or obesity medication and/or
    ii) administering CT scans at a frequency of no more than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is not increased relative to a reference; or an expression level of at least one gene selected from: miR424-5p, miR-326, miR424-5p, miR-27a-3p, miR320b and miR320d; which is not decreased relative to a reference.

14. The method of any of the preceding paragraphs, wherein the glucose-controlling medication is selected from the group consisting of: metformin, a sulfonylurea, a glinide, a SGLT2 inhibitor, and insulin.

15. The method of any of the preceding paragraphs, wherein the glucose-controlling medication is metformin.

16. The method of any of the preceding paragraphs, wherein the obesity medication selected from the group consisting of: orlistat, phentermine-topiramate, naltrexone-bupropion, liraglutide, semagludtide, setmelanotide, phentermine, benzphetamine, diethylpropion, and phendimetrazine.

17. The method of any of the preceding paragraphs, wherein the level of expression is the level of mRNA.

18. The method of any of the preceding paragraphs, wherein the exosome is 30-90 nm in diameter.

19. The method of any of the preceding paragraphs, wherein the exosome originates from a non-tumor tissue.

20. The method of any of the preceding paragraphs, wherein the exosome is isolated from a non-tumor tissue and/or cells.

21. The method of any of the preceding paragraphs, wherein the non-tumor tissue and/or cells is blood, plasma, adipose tissue, adipocytes, or bone.

22. The method of any of the preceding paragraphs, wherein the method further comprises determining the expression level of at least one gene selected from COMP, TSP5, BRD2, BRD3, miR103a, and SOX-2-OT in tumor tissue obtained from the subject.

23. The method of any of the preceding paragraphs, wherein the cancer is an epithelial cancer.

24. The method of any of the preceding paragraphs, wherein the cancer is an epithelial adenocarcinoma.

25. The method of any of the preceding paragraphs, wherein the cancer is esophageal cancer, pancreatic cancer, cervical cancer, colorectal cancer, gastric cancer, lung cancer, uterine caner, renal cancer, breast cancer, or prostate cancer.

26. The method of any of the preceding paragraphs, wherein the cancer is breast and/or prostate cancer.

27. The method of any of the preceding paragraphs, wherein the subject is diabetic, overweight, and/or obese.

28. The method of any of the preceding paragraphs, wherein the subject is identified as diabetic when they are determined to have HbA1c of 6.5% or greater, or by fasting glucose or fasting insulin.

29. A method of treating cancer in a subject in need thereof, the method comprising administering to the subject exosomes which are:
  a) from a non-diabetic and/or non-obese donor; and/or
  b) determined to have an level of expression of at least one gene selected from:
    miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
    a level of expression of at least one gene selected from:
    miR424-5p, miR-326, miR424-5p, miR-27a-3p, miR320b and miR320d; which is not increased, wherein the level of expression is relative to the level of expression in a exosome obtained from a healthy non-diabetic subject.

30. A method of treating cancer in a subject in need thereof, the method comprising administering to the subject:
  a) an inhibitor of at least one gene selected from:
    miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
  b) an agonist of at least one gene selected from:
    miR424-5p, miR-326, miR424-5p, miR-27a-3p, miR320b and miR320d;

31. The method of paragraph 29 or 30, wherein the subject is one determined to have: an increased level of expression of at least one gene selected from:
  miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or
  a decreased level of expression of at least one gene selected from:
  miR424-5p, miR-326, miR424-5p, miR-27a-3p, miR320b and miR320d.

32. The method of any one of paragraphs 29-31, wherein the cancer is epithelial cancer.

33. The method of any one of paragraphs 29-32, wherein the cancer is prostate cancer.

34. The method of any one of paragraphs 29-33, wherein the subject in need of treatment for cancer is diabetic and/or obese.
35. The method of any one of paragraphs 29-34, whereby EMT is reduced in the subject.
36. The method of any one of paragraphs 29-35, wherein the subject is further administered a BET inhibitor or PROTAC degrader.

In some embodiments, the present technology may be defined in any of the following numbered paragraphs:

1. A method comprising:
   determining the expression of at least one gene selected from the group consisting of:
      miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, AHNAK, miR-424-5p, miR-326, miR424-5p, miR-27a-3p, miR320b, and miR320d;
   in an exosome obtained from a subject.
2. The method of paragraph 1, wherein the expression of at least one gene selected from the group consisting of: miR374a-5p, miR-93-5p, miR-28-3p, miR-let-7b-3p, miR-375, miR-424-5p, miR-326, miR424-5p, miR-27a-3p, miR320b, and miR320d; is determined.
3. The method of paragraph 1, wherein the expression of at least one gene selected from the group consisting of: miR374a-5p, miR-93-5p, miR-28-3p, miR-let-7b-3p, and miR-375; is determined.
4. The method of paragraph 1, wherein the expression of at least two genes selected from the group consisting of: miR374a-5p, miR-93-5p, miR-28-3p, miR-let-7b-3p, and miR-375; is determined.
5. The method of paragraph 1, wherein the expression of at least three genes selected from the group consisting of: miR374a-5p, miR-93-5p, miR-28-3p, miR-let-7b-3p, and miR-375; is determined.
6. The method of paragraph 1, wherein the expression of at least four genes selected from the group consisting of: miR374a-5p, miR-93-5p, miR-28-3p, miR-let-7b-3p, and miR-375; is determined.
7. The method of paragraph 1, wherein the expression of at least miR374a-5p, miR-93-5p, miR-28-3p, miR-let-7b-3p, and miR-375; is determined.
8. The method of paragraph 1, wherein the expression of at least miR374a-5p is determined.
9. The method of paragraph 1, further comprising:
   i) administering a glucose-controlling medication or obesity medication and/or
   ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference.
10. The method of paragraph 1, further comprising:
    i) administering a glucose-controlling medication or obesity medication and/or
    ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference; or
    i) not administering a glucose-controlling medication or obesity medication and/or
    ii) administering CT scans at a frequency of no more than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is not increased relative to a reference; or an expression level of at least one gene selected from: miR424-5p, miR-326, miR424-5p, miR-27a-3p, miR320b and miR320d; which is not decreased relative to a reference.
11. A method of treating cancer, comprising:
    i) administering a glucose-controlling medication or obesity medication and/or
    ii) administering CT scans at a frequency of higher than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is increased relative to a reference; or an expression level of at least one gene selected from: miR424-5p, miR-326, miR424-5p, miR-27a-3p, miR320b and miR320d; which is decreased relative to a reference.
12. The method of paragraph 11, further comprising:
    i) not administering a glucose-controlling medication or obesity medication and/or
    ii) administering CT scans at a frequency of no more than 1 CT scan every 6 months, to a subject determined to have an expression level of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK which is not increased relative to a reference; or an expression level of at least one gene selected from: miR424-5p, miR-326, miR424-5p, miR-27a-3p, miR320b and miR320d; which is not decreased relative to a reference.
13. The method of paragraph 11, wherein the glucose-controlling medication is selected from the group consisting of: metformin, a sulfonylurea, a glinide, a SGLT2 inhibitor, and insulin; or the obesity medication selected from the group consisting of: orlistat, phentermine-topiramate, naltrexone-bupropion, liraglutide, semagludtide, setmelanotide, phentermine, benzphetamine, diethylpropion, and phendimetrazine.

14. The method of paragraph 1, wherein the level of expression is the level of mRNA.
15. The method of paragraph 1, wherein the exosome originates from or is isolated from a non-tumor tissue or cells.
16. The method of paragraph 15, wherein the non-tumor tissue or cells is blood, plasma, adipose tissue, adipocytes, or bone.
17. The method of paragraph 11, wherein the cancer is an epithelial cancer.
18. The method of paragraph 17, wherein the cancer is an epithelial adenocarcinoma, esophageal cancer, pancreatic cancer, cervical cancer, colorectal cancer, gastric cancer, lung cancer, uterine caner, renal cancer, breast cancer, or prostate cancer.
19. The method of paragraph 11, wherein the subject is diabetic, overweight, or obese.
20. A method of treating cancer in a subject in need thereof, the method comprising administering to the subject exosomes which are:
   a) from a non-diabetic and/or non-obese donor; and/or
   b) determined to have an level of expression of at least one gene selected from: miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
   a level of expression of at least one gene selected from:
   miR424-5p, miR-326, miR424-5p, miR-27a-3p, miR320b and miR320d; which is not increased, wherein the level of expression is relative to the level of expression in a exosome obtained from a healthy non-diabetic subject.
21. A method of treating cancer in a subject in need thereof, the method comprising administering to the subject:
   a) an inhibitor of at least one gene selected from:
   miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; which is not increased; and/or
   b) an agonist of at least one gene selected from:
   miR424-5p, miR-326, miR424-5p, miR-27a-3p, miR320b and miR320d;
22. The method of paragraph 20, wherein the subject is one determined to have:
   an increased level of expression of at least one gene selected from:
   miR374a-5p, miR-93-5p, miR-28-3p, miR-let-7b-3p, miR-375, TSP5, Snail (SNAI1), Twist (TWIST1), Slug (SNAI2), vimentin (VIM), E-cadherin (CDH1), ZEB1, and AHNAK; or
   a decreased level of expression of at least one gene selected from:
   miR424-5p, miR-326, miR424-5p, miR-27a-3p, miR320b and miR320d.

The technology described herein is further illustrated by the following examples which in no way should be construed as being further limiting.

EXAMPLES

Example 1

Breast and prostate cancer patients who also have chronic inflammatory diseases, such as Type 2 diabetes, have a higher risk of metastasis than patients with the same stage and type of cancer who have normal Immunometabolism. There is a need for new patient treatment paradigms that rely on assessment of the patient's immunometabolism state which then informs changes to clinical management. Most cancer biomarkers rely on markers derived from or induced by cancer cells. Remarkably, the system described herein to assess cancer risk relies on signals from non-tumor tissue which are shown to induce dangerous changes in cancer cells. Novel diagnostic tools are needed because cancer patient metabolism, medications and adipocyte or bone health are typically not considered in evaluating risk for progression or metastasis of these cancers. Clinical decision making could be greatly improved for patients at-risk for cancer progression on account of their metabolic co-morbidities. The >100 million Americans who are diabetic or pre-diabetic at present are insufficiently served the standard of care in breast and prostate medical oncology.

The inventors have identified small extracellular vesicles called exosomes (about 30-90 nm in diameter) that originate in non-tumor tissue, such as fat or bone, that carry molecular signals that promote more dangerous (pro-metastatic) changes in breast or prostate cancer cell lines, respectively. These factors are also found in the peripheral blood of cancer patients and are used to profile to assist clinical decision making about risks for progression and metastasis. This information can be used to influence a clinician's choices among therapeutic options, and help patients understand their risks. Drugs that improve metabolism and inflammation may reduce this biomarker, which is expected to reduce risk for cancer metastasis, and would inform the patient/clinician decision making over time.

The invention encompasses a method of isolating exosomes and using gene signatures from patient blood, plasma or other non-malignant tissue to determine patient risk signature for cancer metastasis. The invention also includes how such signatures are used to define subsequent patient-specific therapies. The methodology to assess and profile risk using exosome plasma biomarkers is applied to profile patients that have or may be at risk for a variety of epithelial adenocarcinoma solid tumors including but not limited to esophageal cancer, pancreatic cancer, cervical cancer, colorectal cancer, gastric cancer, lung cancer, uterine, renal, breast and prostate cancers. The use of adipocytes from a tissue biopsy to assess and profile cancer risk assessment is also novel. The invention specifically includes assessment of cancer EMT markers (associated with progression and metastasis) using exosomes isolated from blood or plasma of patients in order to delineate subsequent therapy and to profile patients for risk of metastasis. The tool provides a functional measure of progression risk, beyond an association of an analyte with a disease state, and can provide a highly personalized profile when tested against a standard array of EMT genes (such as commercially available 87-gene arrays).

The approach has the potential to capture data of added value to cancer disparities populations. For example, a recent paper in JAMA Oncology (PMID: 33475714) draws the important conclusion from a large cohort study that Black women in the U.S. are more likely to have a high-risk recurrence score and to die of axillary node-negative breast cancer than non-Hispanic White women with comparable recurrence scores. The Oncotype DX Breast Recurrence Score test for a 21-gene signature has lower prognostic accuracy in Black women, suggesting that personalized assays used to identify candidates for adjuvant chemotherapy requires model calibration in populations with greater racial/ethnic diversity. Thus this more personalized diagnostic information provided by the present method will improve risk assessment and save lives.

Certain patients, such as diabetic patients, especially benefit from the methods of this invention. Diabetic patients are identified using standard methods, including HbA1c which is used as a quick test clinically to determine who is diabetic (6.5% or greater). Fasting glucose and fasting insulin are desirable, and more preferred in clinical studies because then a measure called HOMA (homeostasis model of insulin resistance) can be calculated. In the general method of the invention, exosomes are then isolated from blood or plasma, fractionated as appropriate, and profiled for transcriptional upregulation. In one example of the invention, the readout is transcriptional upregulation of four gene sets (AHNAK, SNAI1 SNAI2 and CDH1) which determines metastatic cancer risk.

In another example, the invention is a system for ranking cancer progression in a diabetic patient diagnosed with a primary breast tumor, comprising isolation of exosomes from blood, plasma or primary adipocytes of said patient; screening exosomes for a set of genes using sequencing, RT-PCR or array methods and in some cases relative to a control; determining the fold-change of the set of genes; and ranking the disease progression potential in the patient. One set of genes of the invention comprises Snail (SNAI1), Twist (TWIST1), Slug (SNAI2), vimentin (VIM), E-cadherin (CDH1) and ZEB1; a control gene may be β-actin (ACTB). Patients may be ranked as being high risk, moderate, or low risk according to the fold change vs. control. In one example of the invention, high risk is defined as >2.5 fold change in at least 4 of the 6 genes vs. control, moderate risk is >1.25 fold but less than 2.5 fold vs. control, and low risk is less than 1.25 fold vs. control.

Example 2

Obesity and metabolic diseases, such as insulin resistance and type 2 diabetes (T2D), are associated with metastatic breast cancer in post-menopausal women. Described herein is the investigation of the critical cellular and molecular factors behind this link. It was found that primary human adipocytes shed extracellular vesicles-specifically exosomes—that induced the expression of genes associated with epithelial-to-mesenchymal transition (EMT) and cancer stem-like cell (CSC) traits in cocultured breast cancer cell lines. Transcription of these genes was further increased in cells exposed to exosomes shed from T2D patient-derived adipocytes or insulin-resistant adipocytes and required the epigenetic reader proteins BRD2 and BRD4 in recipient cells. The thrombospondin family protein TSP5, which is associated with cancer, was more abundant in exosomes from T2D or insulin-resistant adipocytes and partially contributed to EMT in recipient cells. Bioinformatic analysis of breast cancer patient tissue showed that greater co-expression of COMP (which encodes TSP5) and BRD2 or BRD3 correlated with poorer prognosis, specifically decreased distant metastasis-free survival. Our findings reveal a mechanism of exosome-mediated crosstalk between metabolically abnormal adipocytes and breast cancer cells that may promote tumor aggressiveness in T2D patients.

Obesity, insulin resistance and Type 2 diabetes (T2D) are risk factors for breast cancer in post-menopausal women (1). The metabolic and inflammatory complications of obesity are implicated in carcinogenesis and progression of estrogen receptor (ER)-positive breast cancer (2). Population studies also establish that obesity-driven T2D associates with incidence (3), progression and mortality (4) of ER-negative breast cancer. However, the cellular and molecular pathways that mediate breast cancer incidence, progression and metastasis are still not fully delineated. In sporadic breast cancer, well known genes that control proliferation, cell cycle, signal transduction, genome stability and other pathways (genes such as MYC, CCND1, ERBB2, TP53 and CDH1) accumulate mutations and contribute in a multistep fashion to expansion of the malignant clone, immune evasion, cell survival, tissue invasion and metastasis. The tumor microenvironment (TME) plays a critical role to promote cancer progression; however, the adipocytes, endothelial cells, immune infiltrates and other somatic cells of the breast typically do not harbor any mutations. Thus, DNA mutational databases are insufficient to understand most TME mechanisms. Co-morbid immunological or metabolic diseases alter the function of non-mutated cells systemically and in the breast TME, which creates opportunities to explore why tumors may progress in one person but not another, despite a similar mutational landscape in the malignant clones. Herein, the inventors focused on differences in the TME of obesity that might reveal novel mechanisms that promote breast cancer progression.

Adipocytes are by mass the preponderant non-malignant cell type in the TME of breast cancer. Yet, compared to immune infiltrates, adipocytes are disproportionately understudied as modifiers of cancer progression. Adipocytes function as an active endocrine tissue, releasing adipokines, such as interleukin-6, tumor necrosis factor (TNF)-a, leptin and adiponectin (5) that play critical roles in tumor cell proliferation, as well as matrix metalloproteinases (MMPs) (6) that are important for tumor invasiveness. Adipocytes also release lipid that nearby breast tumor cells adapt for fuel by fatty acid oxidation, becoming more aggressive upon this metabolic reprogramming (7).

As the obesity epidemic continues to deepen worldwide, understanding the nature and function of adipocyte intercellular communication is increasing in importance. Extracellular vesicles and a subtype thereof called exosomes have gained attention as facilitators of adipocyte crosstalk with nearby tissues, potentially including malignant or pre-malignant breast epithelial cells (2,7). Adipocyte dysfunction is a long-appreciated feature of obesity-associated metabolic diseases, including insulin resistance, glucose intolerance, and T2D. Here, the inventors investigated whether the altered secretome of metabolically dysfunctional adipocytes, including changes to the adipocyte exosome profile, may promote breast cancer development and progression. The present investigation focused on novel exosome crosstalk between metabolically abnormal adipocytes and breast cancer cells.

Results

Adipocyte-Tumor Cell Co-Culture as a Microenvironment Model

To investigate the role of adipocytes in breast cancer progression, the inventors first used a transwell system to co-culture the human ER-positive cell line MCF7 with human adipocytes that had been differentiated from primary pre-adipocytes surgically obtained from cancer-free, female patients with or without T2D undergoing bariatric surgery. It was observed that the expression of key genes that are important for epithelial-to-mesenchymal transition (EMT), a transcriptional signature associated with tumor progression (8; including SNAIL, SNAI2, VIM, CDH2 and TWIST]; and MMPs including MMP3 and MMP9) were increased upon co-culture (FIG. 1A and data not shown). Fold-changes in EMT gene expression were greater if the adipocytes had first been rendered insulin resistant (IR) by overnight exposure to low-dose TNFa (9). Ingenuity Pathway Analysis (IPA) of differentially expressed genes (FIG. 1B and data file S2) indicated that IR-converted adipocytes (FIG. 1C) more strongly induced EMT pathways in co-cultured MCF7 cells than did insulin-sensitive (IS) adipocytes, as compared to MCF7 controls alone (without co-culture). To explore how crosstalk within the TME induces such transcriptional signatures and complex cellular phenotypes, the inventors focused on the induction of EMT genes. This approach permitted exploration of how novel crosstalk in the TME induces transcriptional signatures and more complex cellular phenotypes than just growth, such as morphology, migration and stemness.

Figure 6A:
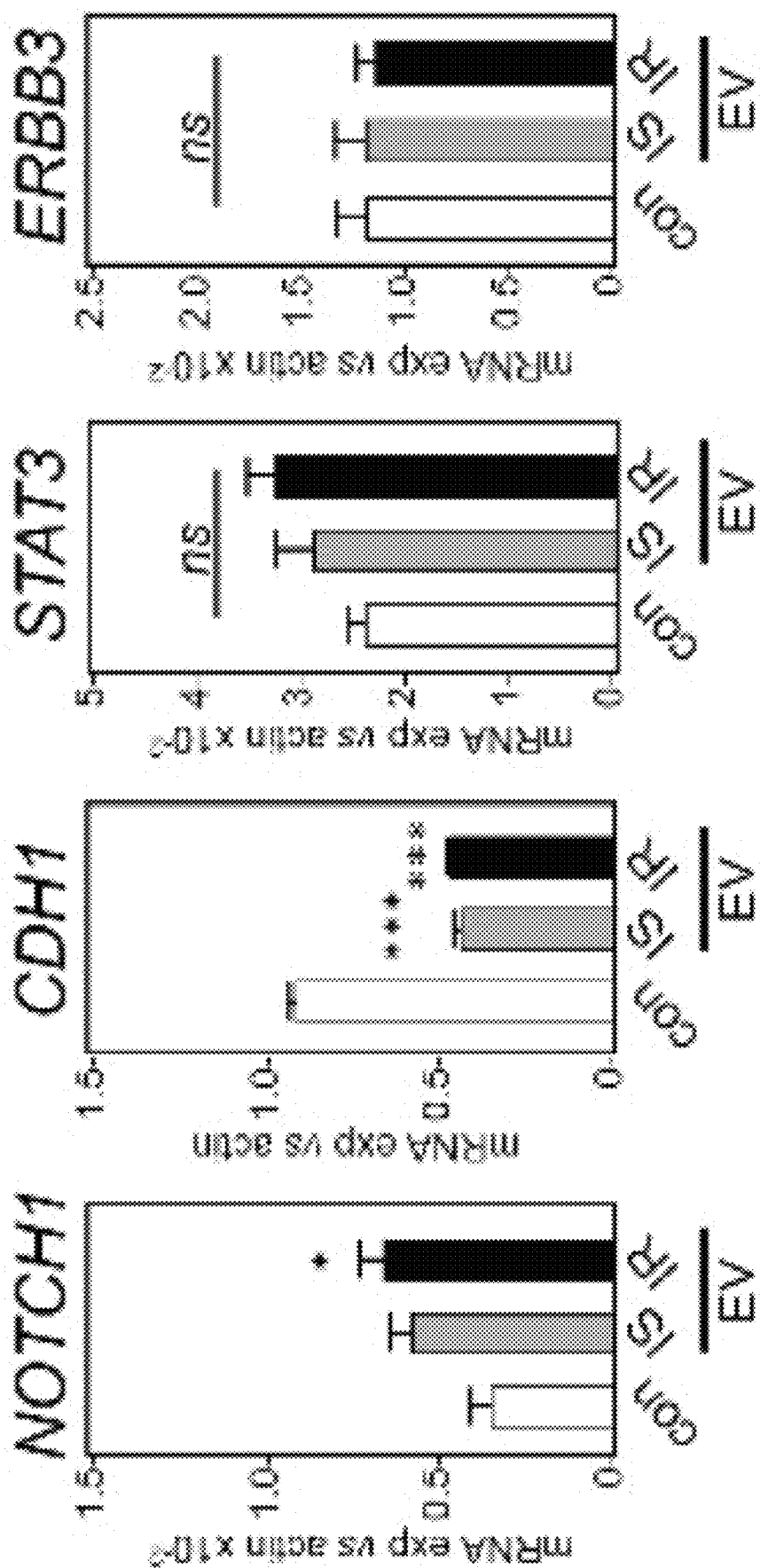
FIGS. 6A-6C depict the selectivity of EMT signatures induced by insulin resistant and insulin sensitive adipocytes.
Figures 6B, 6C:
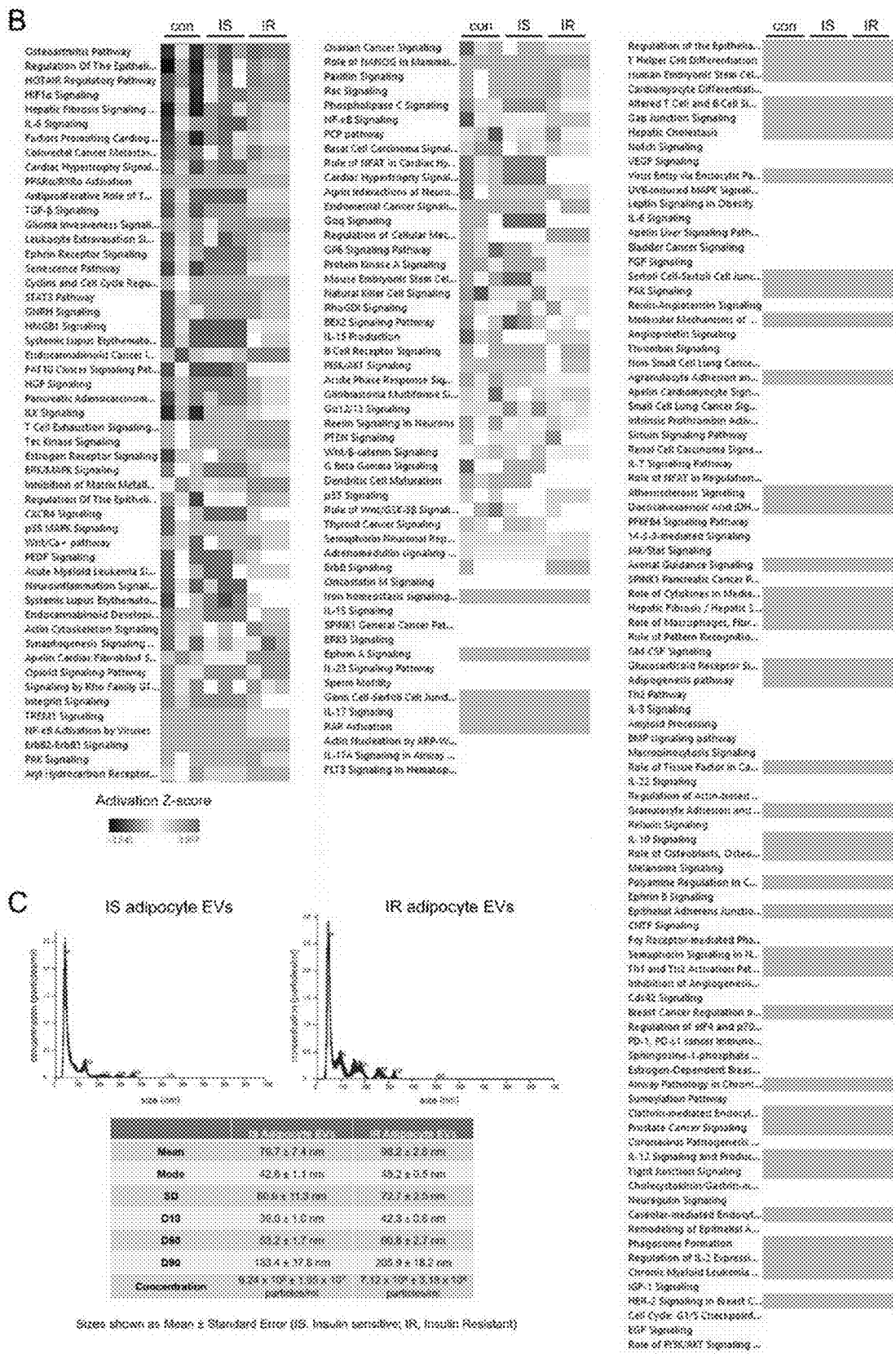

The inventors hypothesized that adipocyte-origin exosomes; were conveying signals to tumor cells. Exosomes were purified from IS or IR adipocyte conditioned media, and used to challenge MCF7 cultures and test function on a target set of EMT genes (FIG. 1D, 6A). Consistent with EMT, exosomes attenuated the expression of genes that encode characteristic epithelial markers, like E-cadherin (CDH1) (FIG. 6A). Exosomes from undifferentiated, pre-adipocyte controls did not induce EMT genes (FIG. 1D). Several gene expression signatures associated with other important pathways, such as cell cycle or cytokine signaling, were relatively unperturbed in tumor cells by co-culture with adipocytes (FIG. 6B). Exosome size distributions were similar between exosomes of IS and IR adipocyte origin (FIG. 6C). Described herein are mechanisms that depend on adipocyte-origin exosomes. Furthermore, these exosomes convey more dangerous signals if the adipocytes are insulin resistant or obtained from patients with obesity-associated metabolic complications.

Adipocyte Exosomes Encode Metabolic Status

Figures 2A, 2B:
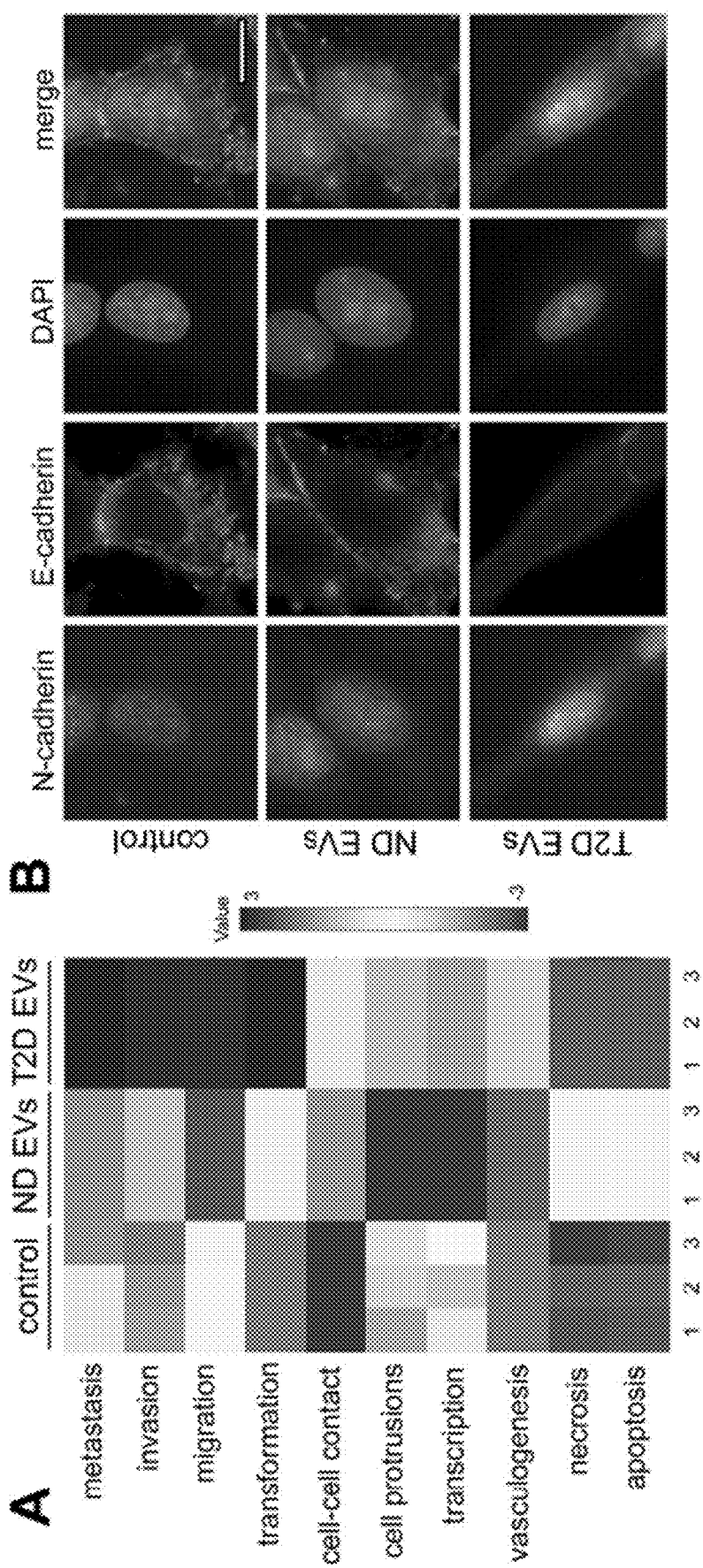
FIGS. 2A-2F demonstrate that EVs from adipocytes of T2D patients show greater induction of EMT and cancer stem-like cell (CSC) genes in breast cancer models than EVs from adipocytes of ND patients. Human primary subcutaneous pre-adipocytes from T2D and non-diabetic (ND) patients were differentiated and EVs were isolated from conditioned media.
Figure 2C:
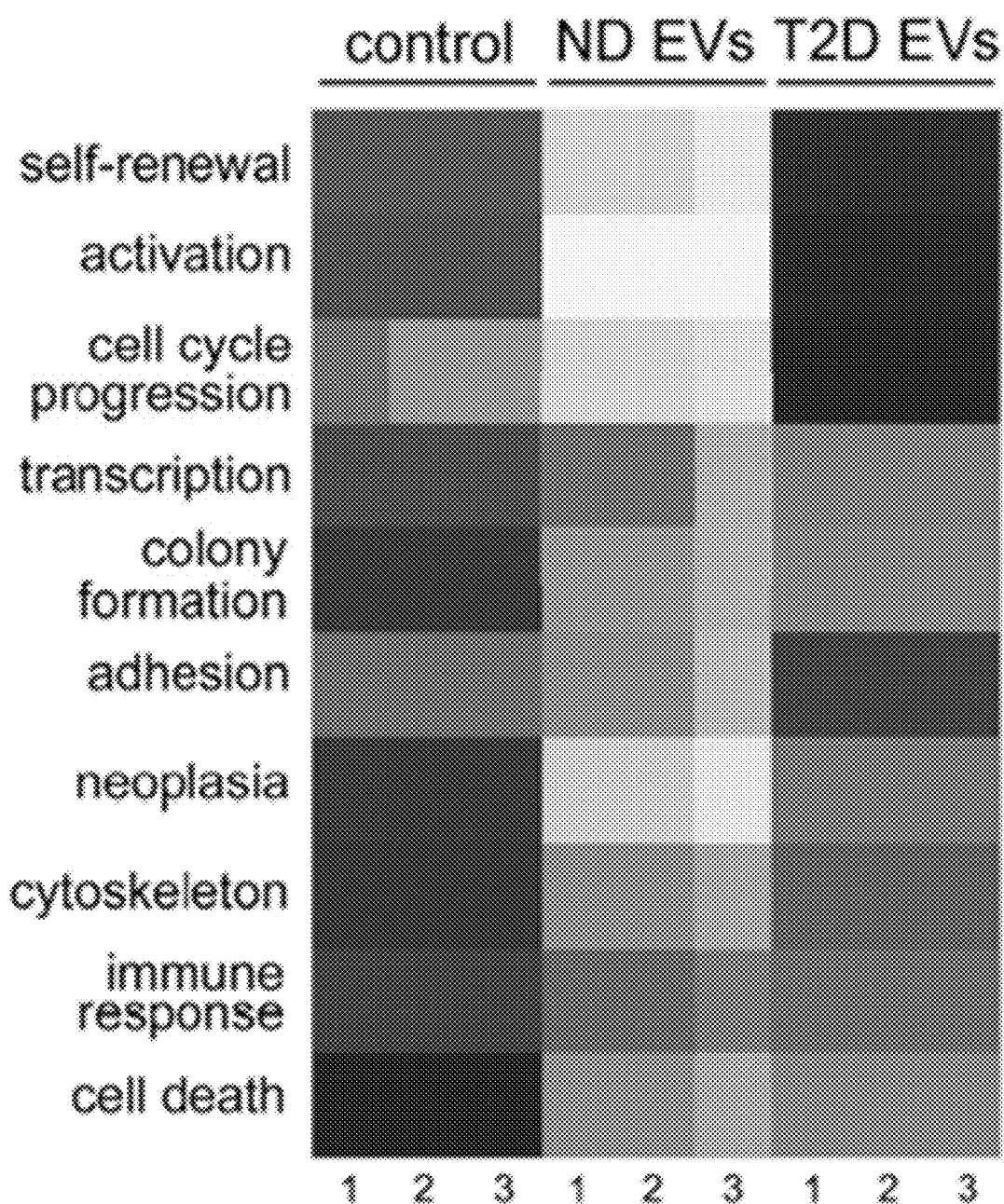
Figures 2D, 2E, 2F:
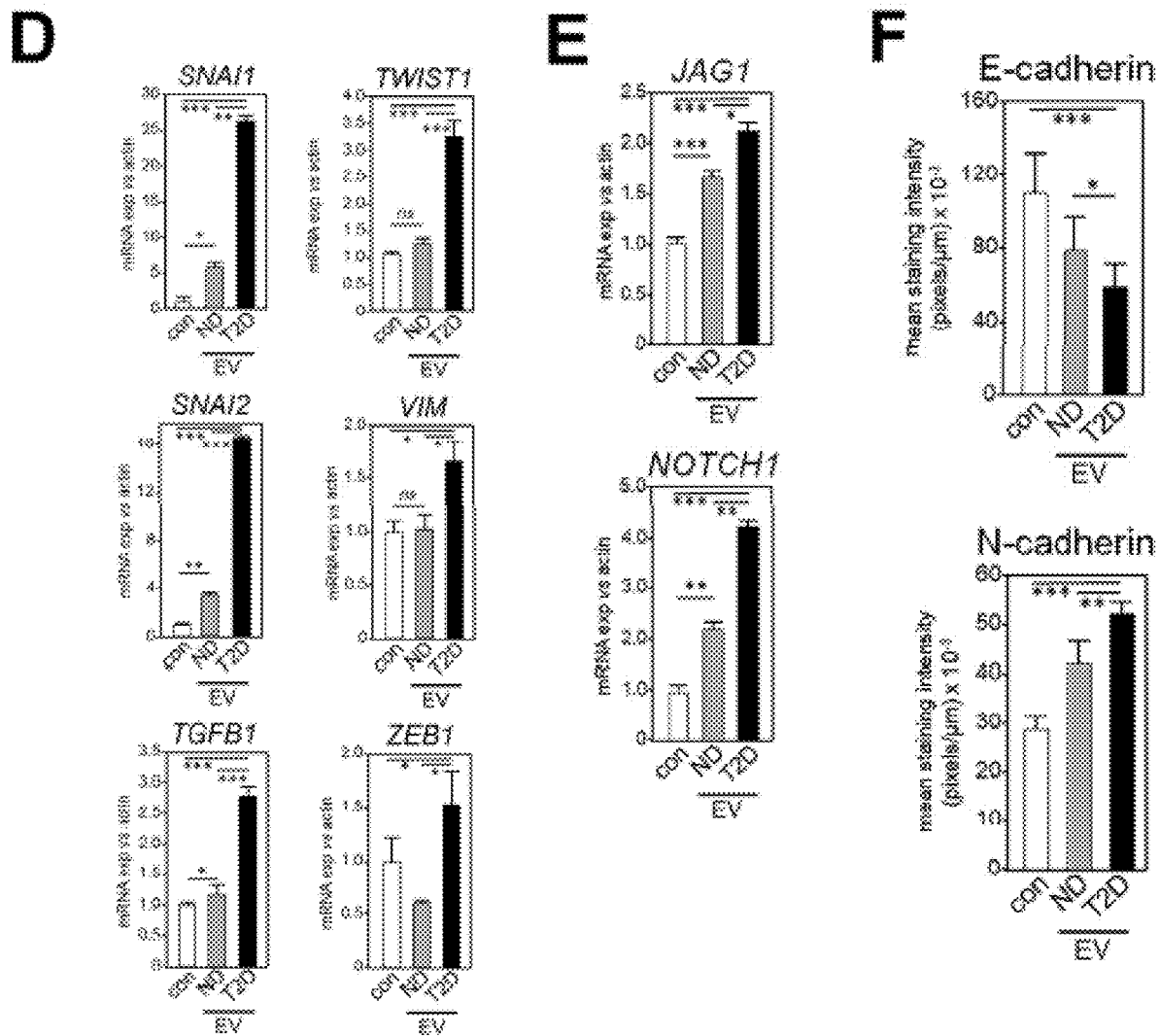
Figure 7A:
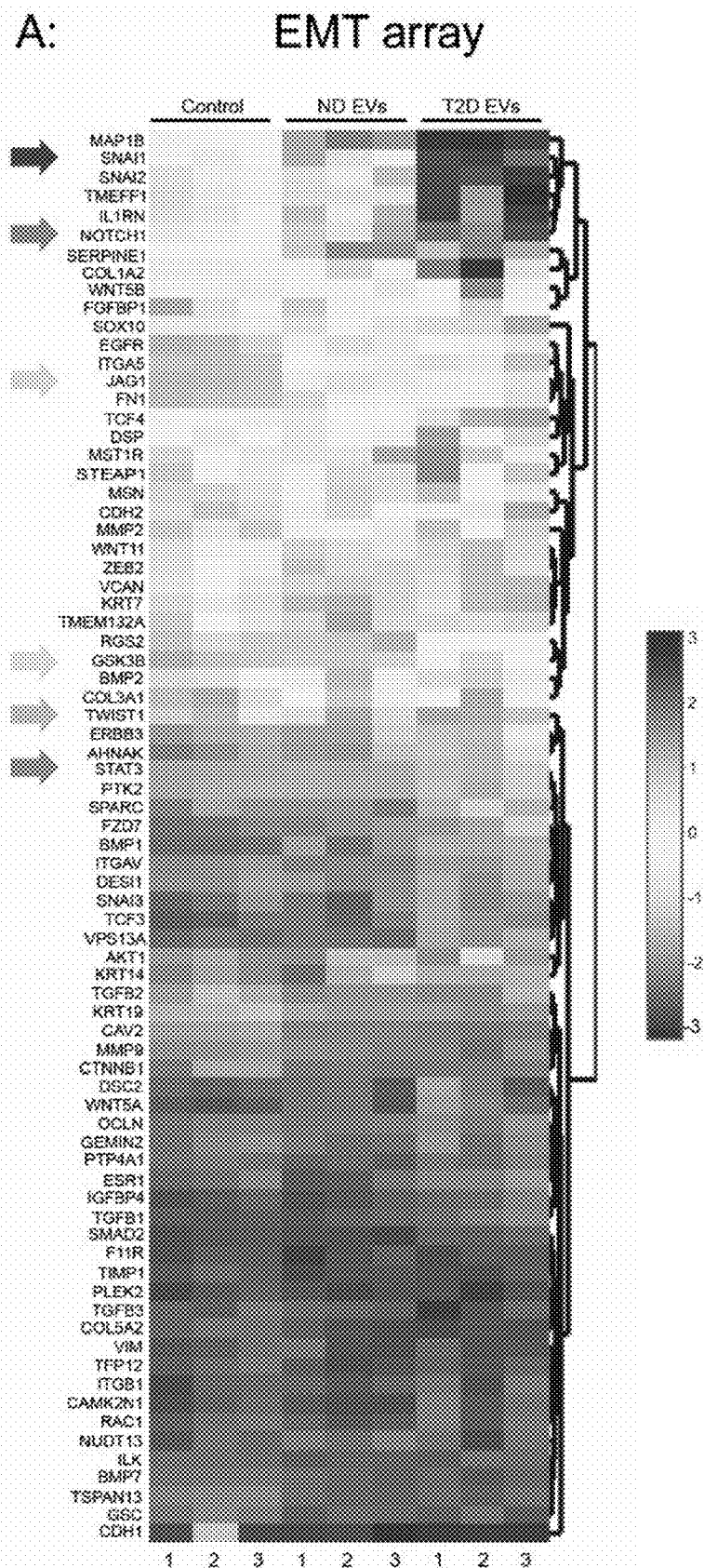
FIGS. 7A-7C depict Ingenuity pathway analysis of MCF-7 genes induced by EVs from adipocytes of ND patients compared to T2D patients.
Figure 7B:
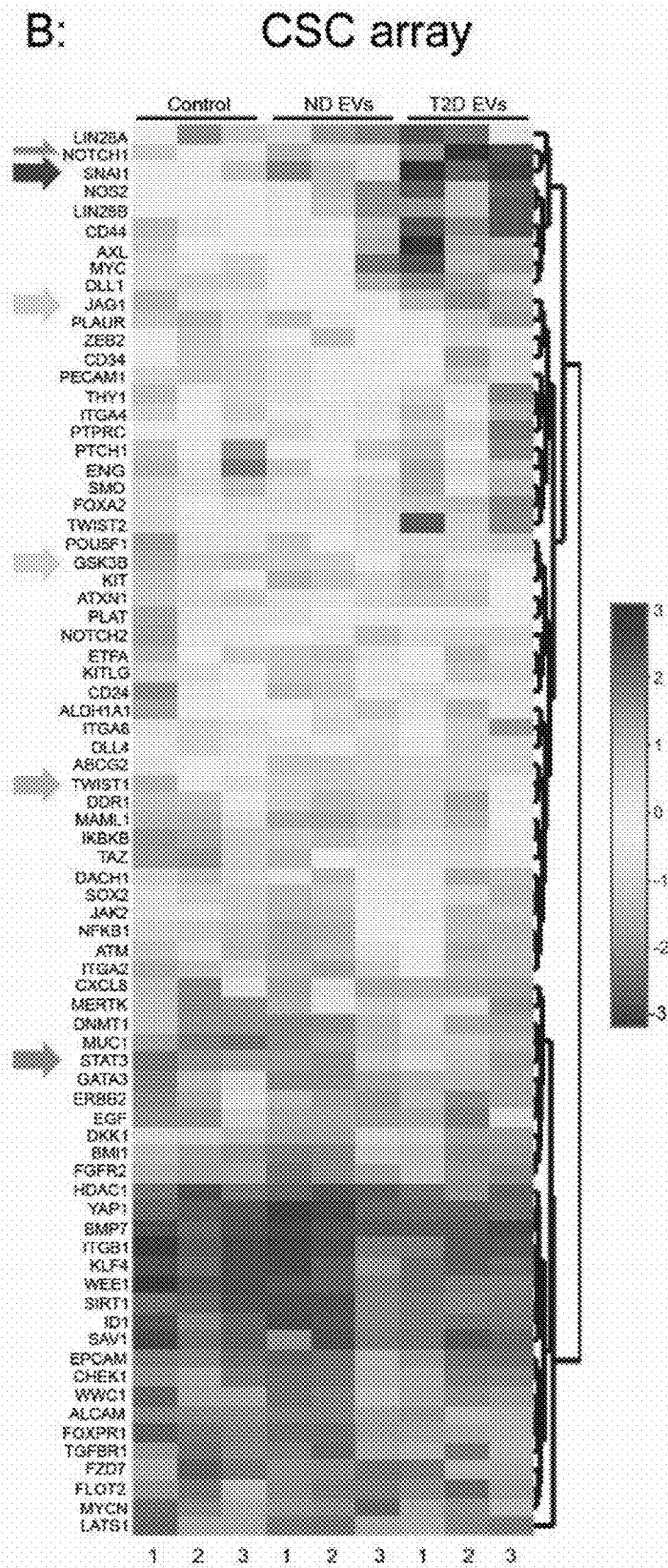
Figure 7C:
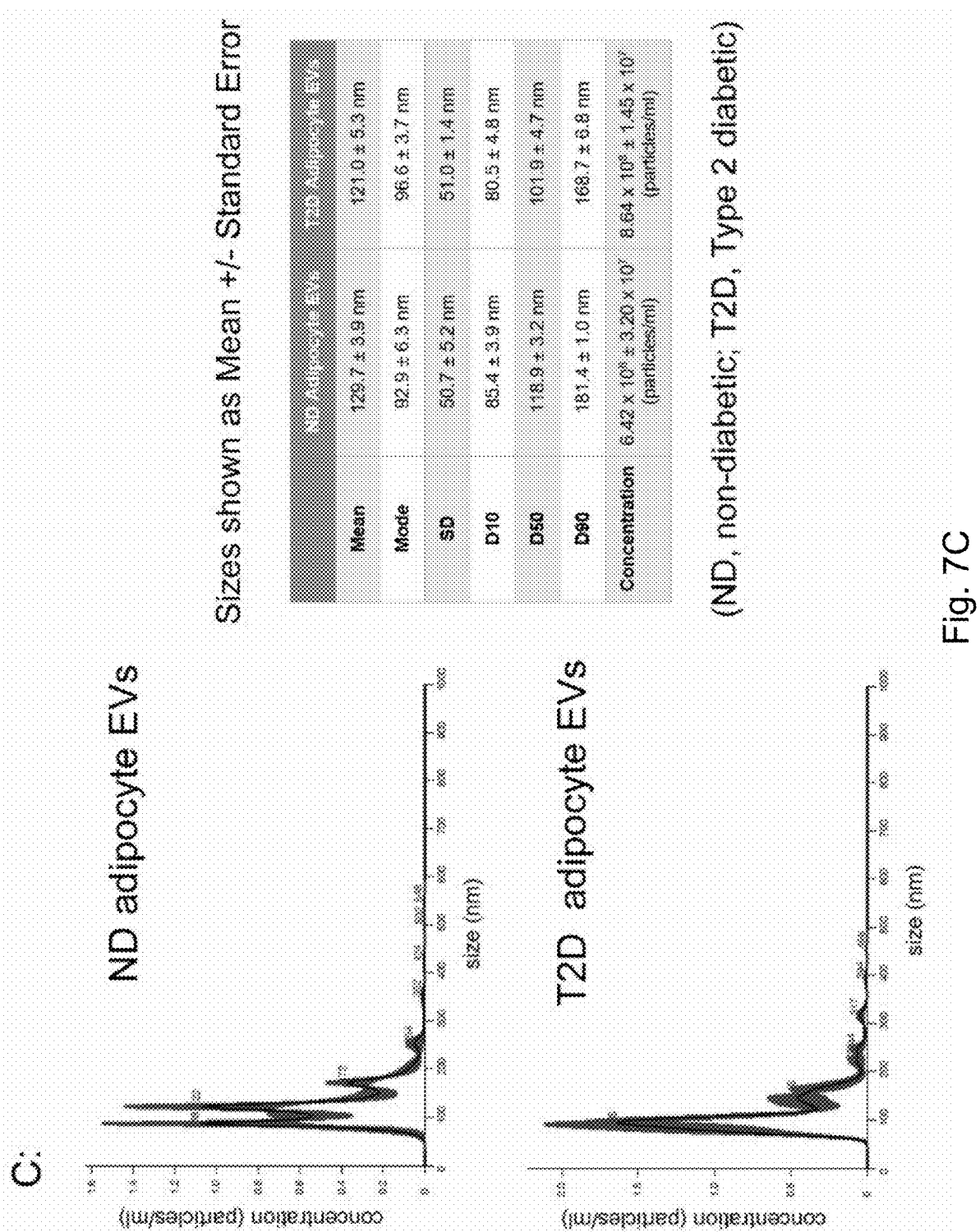

In post-menopausal women with obesity, adipokines and adipocyte-induced estrogen production (14), pro-inflammatory, CD68+ adipose tissue macrophages in "crown-like structures" (15), and adipocyte-released free fatty acids (7) have each been implicated in ER+ breast tumor progression. The association of obesity-driven T2D with elevated risk for progression of ER-negative breast cancer (3,4), suggests novel THE crosstalk drives tumor progression independent of tumor hormone status. Thus, the inventors next compared exosomes purified from primary T2D-derived adipocytes (isolated as pre-adipocyte progenitors from patients and differentiated ex vivo) to exosomes purified from adipocytes derived from non-diabetic controls matched by age, sex and 20 BMI (FIG. 13). Consistent with exosome results from IR adipocytes, exosomes from T2D adipocytes induced the expression of genes associated with pathways linked to breast cancer aggressiveness, such as invasion and migration (FIG. 2A) and EMT (FIG. 7A), compared to non-diabetic (ND) exosomes (data not shown). Immunofluorescence imaging confirmed differential regulation of critical EMT proteins (FIG. 2B). Similar results were obtained for genes and their inferred pathways associated with cancer cell stemness (16) (FIG. 2C, 7B). Like exosomes from IS and IR adipocytes, exosome size distributions were similar between exosomes from ND and T2D adipocytes (FIG. 7C). Individual transcripts were validated by RT-PCR (FIGS. 2D and 2E). T2D adipocyte exosomes attenuated gene expression that is associated with cell death pathways (FIG. 2A-2C) and downregulated those encoding epithelial markers (FIG. 2F). Thus, the data indicate that patient metabolic status reprograms breast cancer cell gene expression—and possibly consequential aggressiveness—through adipocyte exosomes.

Figure 3A:
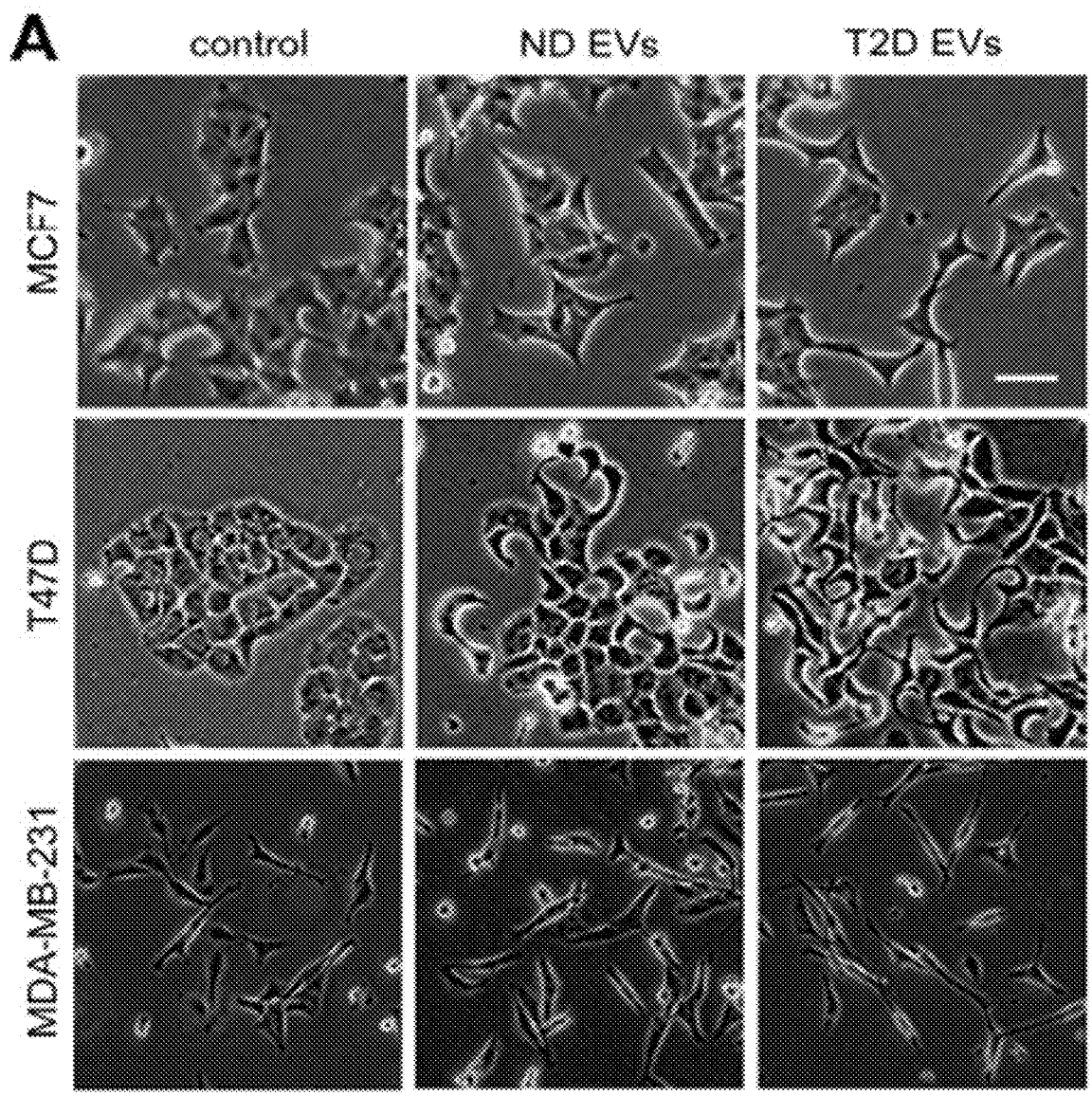
Figure 3B:
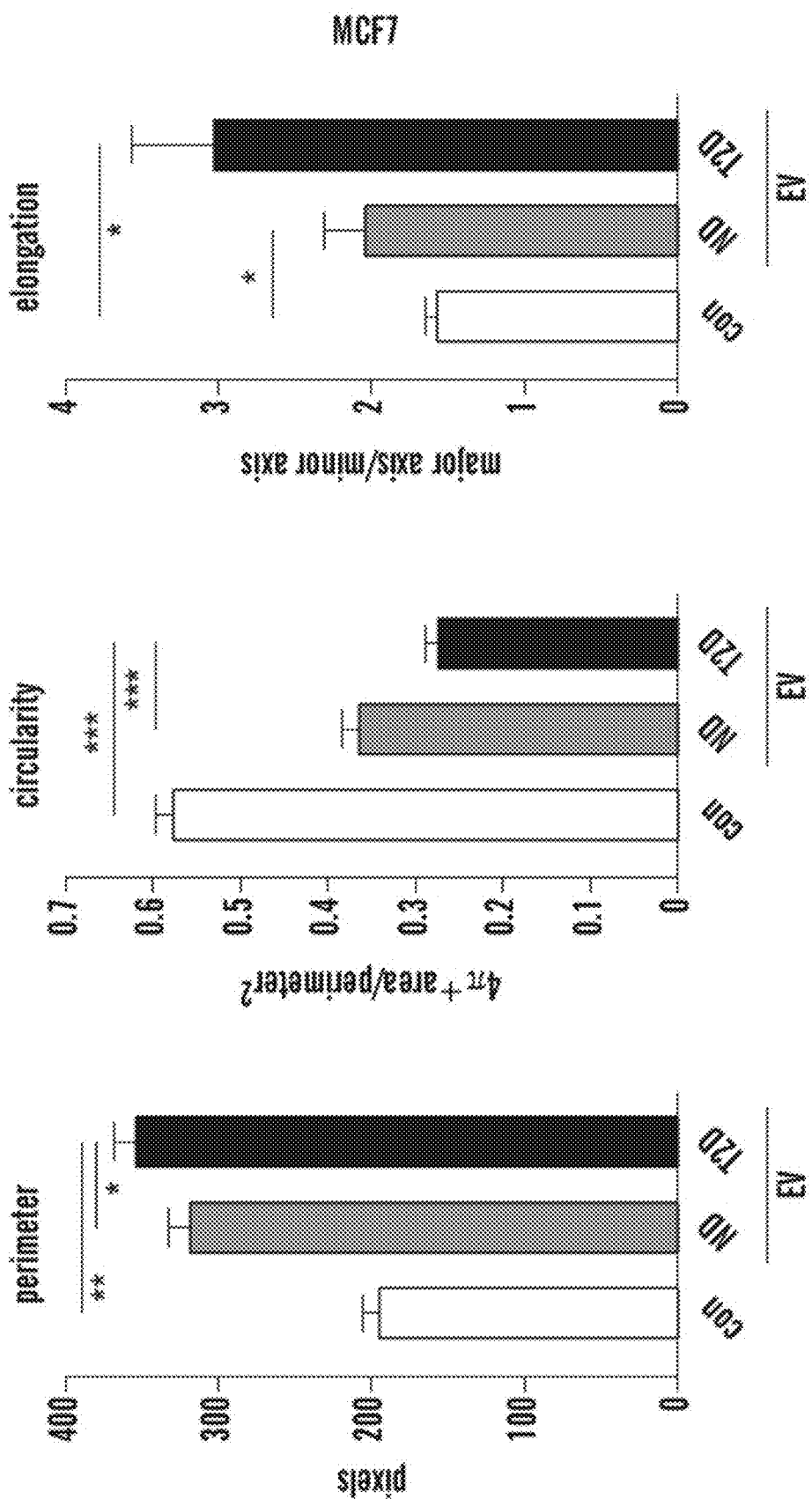
Figure 3B:
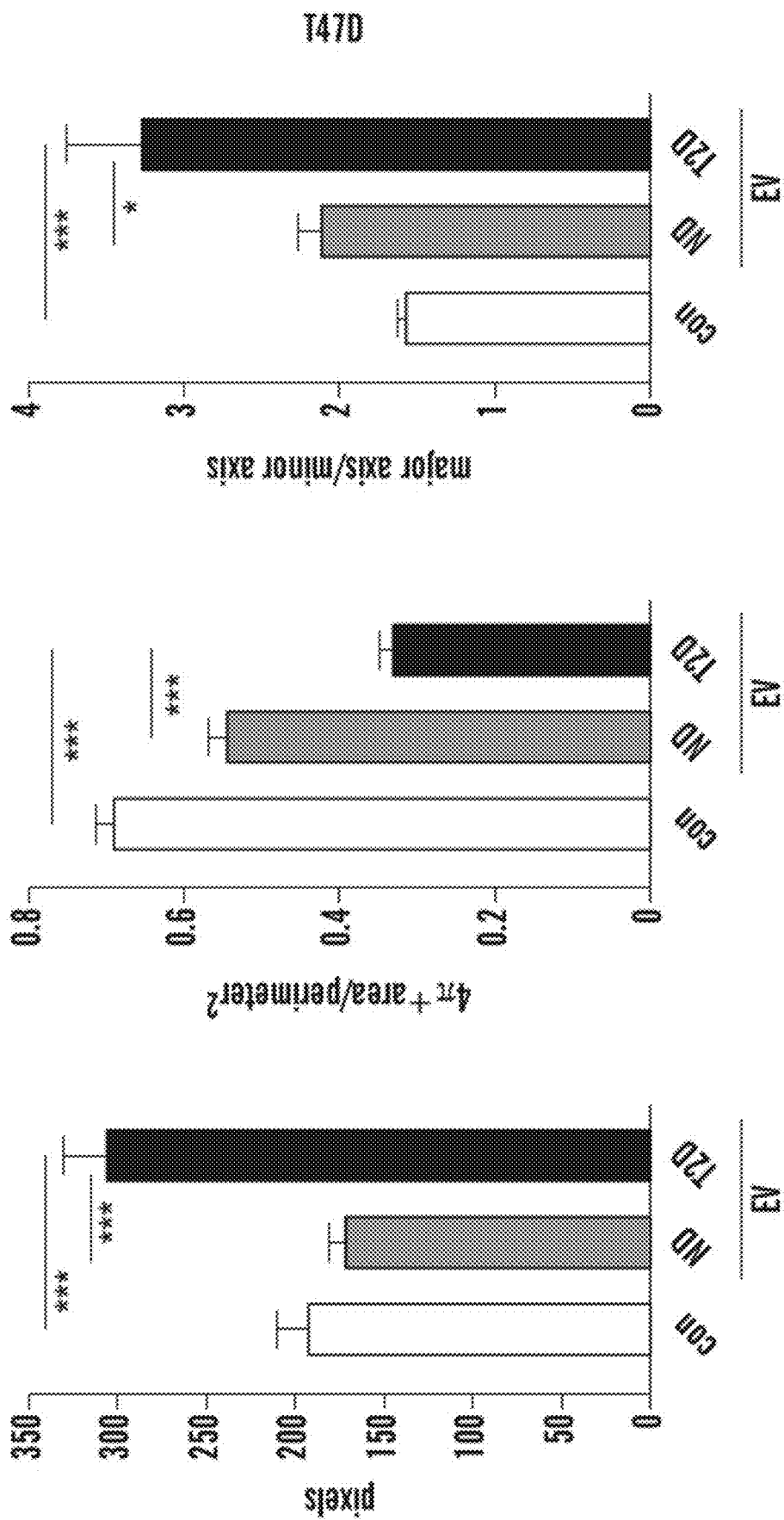
Figure 3B:
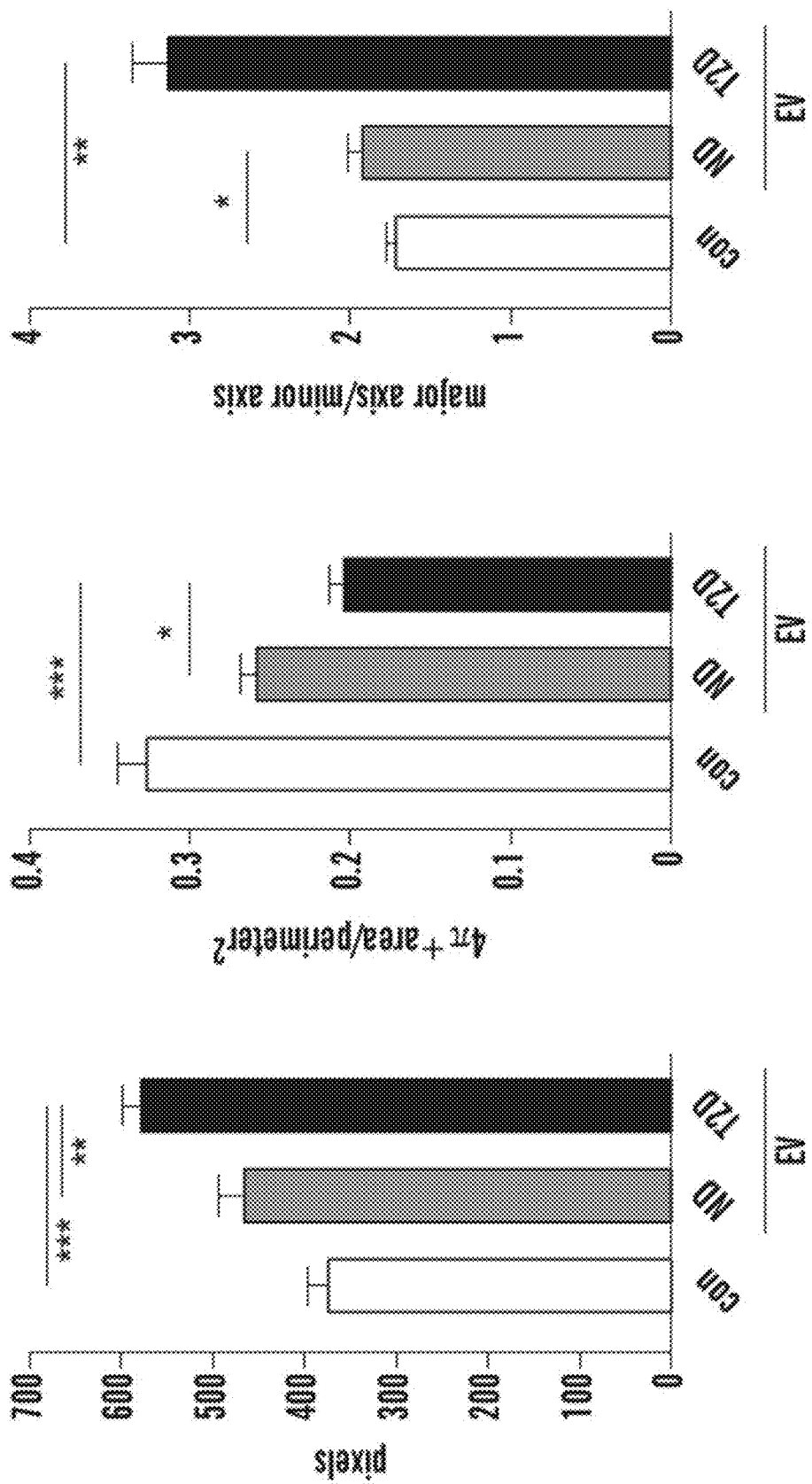
Figures 3C, 3D:
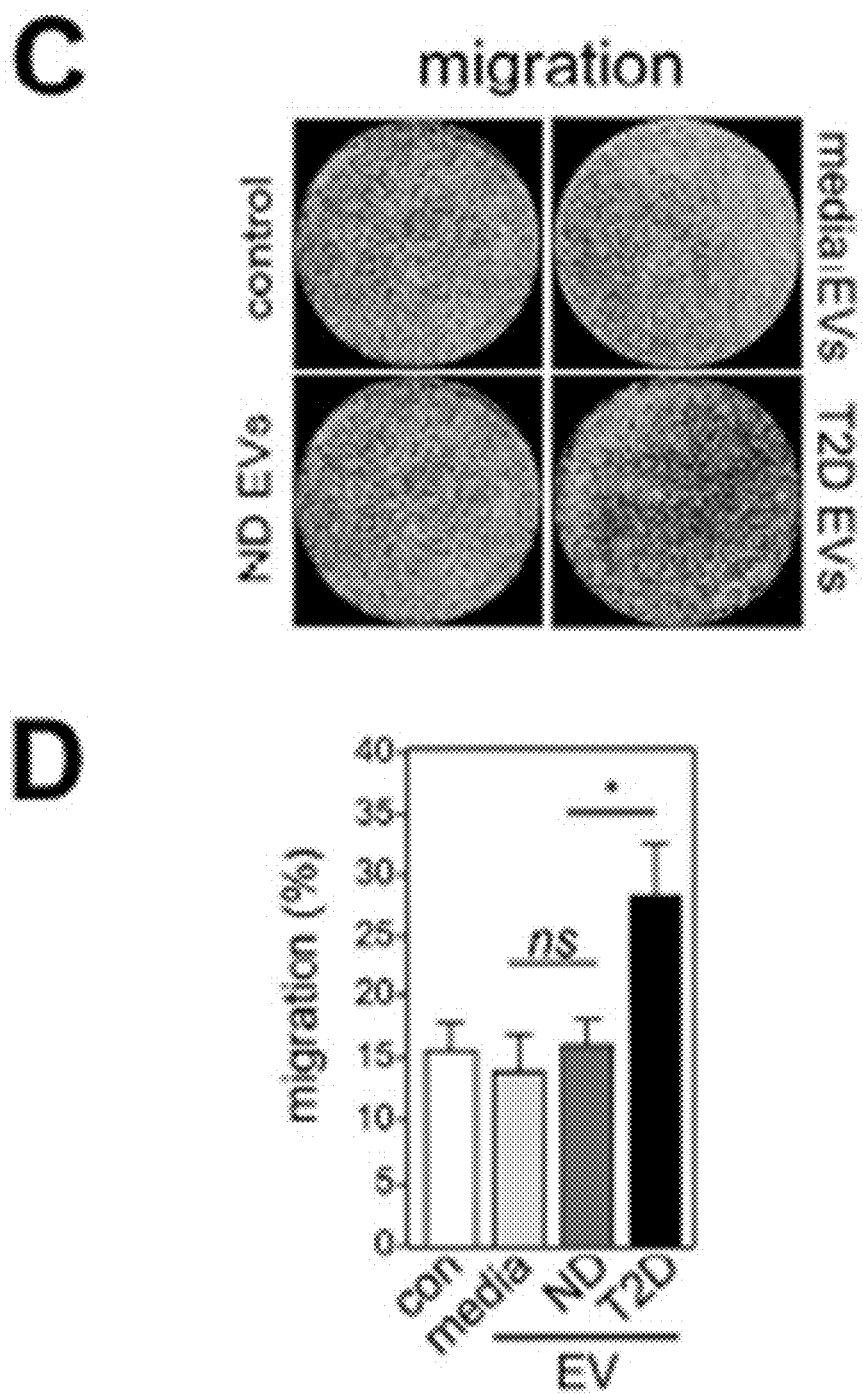
Figure 8:
FIG. 8 depicts Ingenuity Pathway Analysis of proteomics signatures. Peptide signals from proteomics analysis of human primary adipocyte exosomes were compared by analysis of signaling and functional pathways, with insulin sensitive (IS) and insulin resistant (IR) states as the independent variables. Consistent with FIG. 1B, selected pathways associated with cell migration and invasion were upregulated in the IR condition compared to IS, whereas selected pathways associated with apoptosis were downregulated.

Exosomes from IR Adipocytes Promote Greater EMT and Morphological Changes in Cancer Cells, Compared to IS Characteristic morphological changes also accompany transcription and protein expression differences in breast tumor cells upon EMT (17), which were measured by image analysis of exosome-treated human cellular models (FIG. 3A). The inventors observed increased cellular perimeter, elongation and reduced circularity upon treatment with exosomes derived from T2D adipocytes compared to ND controls (FIG. 3B). Transwell experiments with MDA-MB-231 cells (18), a model for human triple negative breast cancer, confirmed that T2D exosomes promote cell migration (FIGS. 3C and 3D). To identify candidate exosome proteins that could account for functional differences between T2D and ND adipocytes, performed proteomics analysis was performed by mass spectrometry (FIG. 3E). The full set of peptides identified by mass spectrometry (FIG. 14) was analyzed by IPA. Results showed that pathways associated with tumor cell aggressiveness (motility, invasion and angiogenesis) were increased in IR exosome payloads compared to IS (FIG. 8), whereas pathways associated with cell death were decreased, consistent with data described above (FIGS. 1 and 2).

Figure 3F:
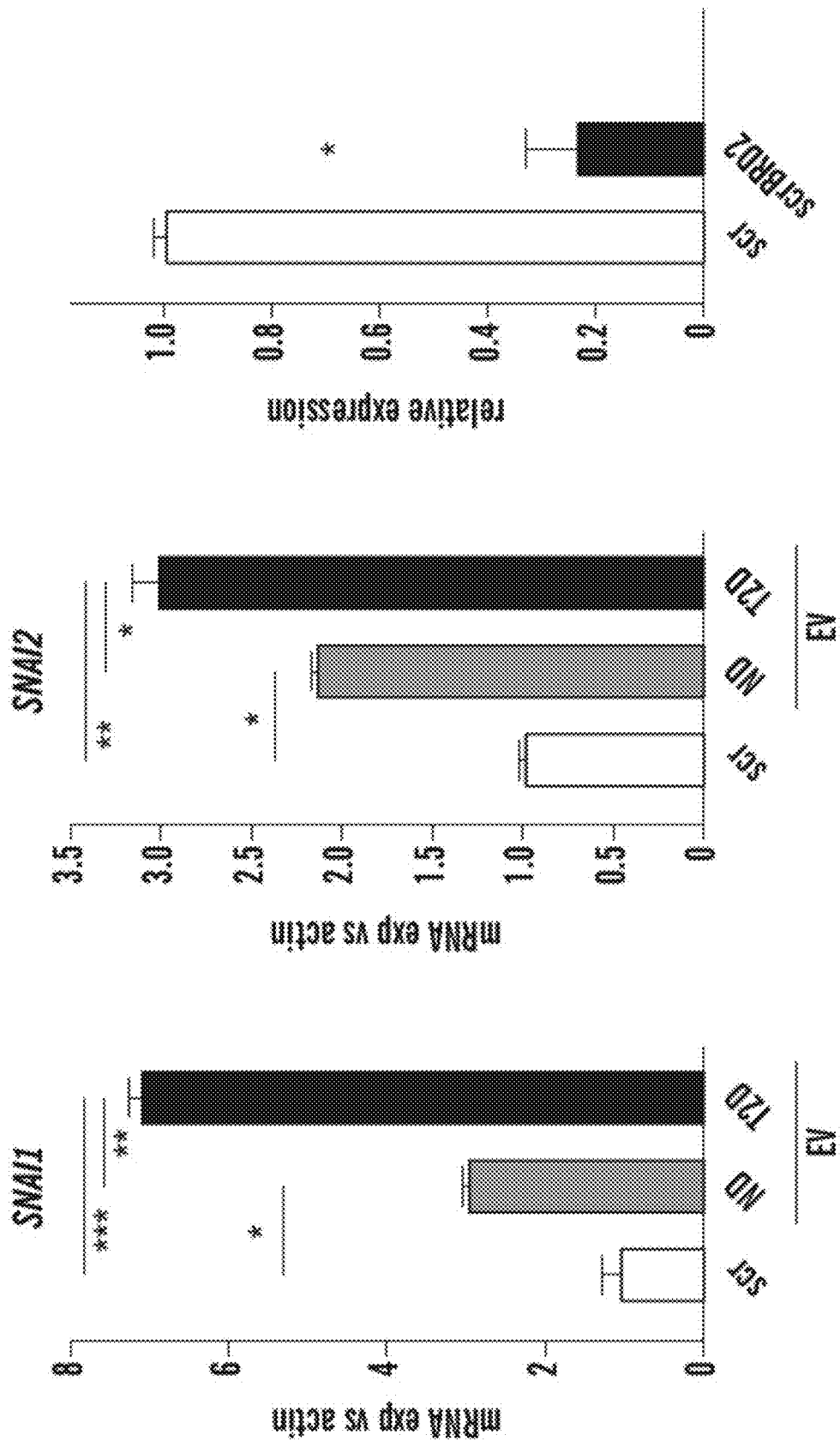
Figure 3F:
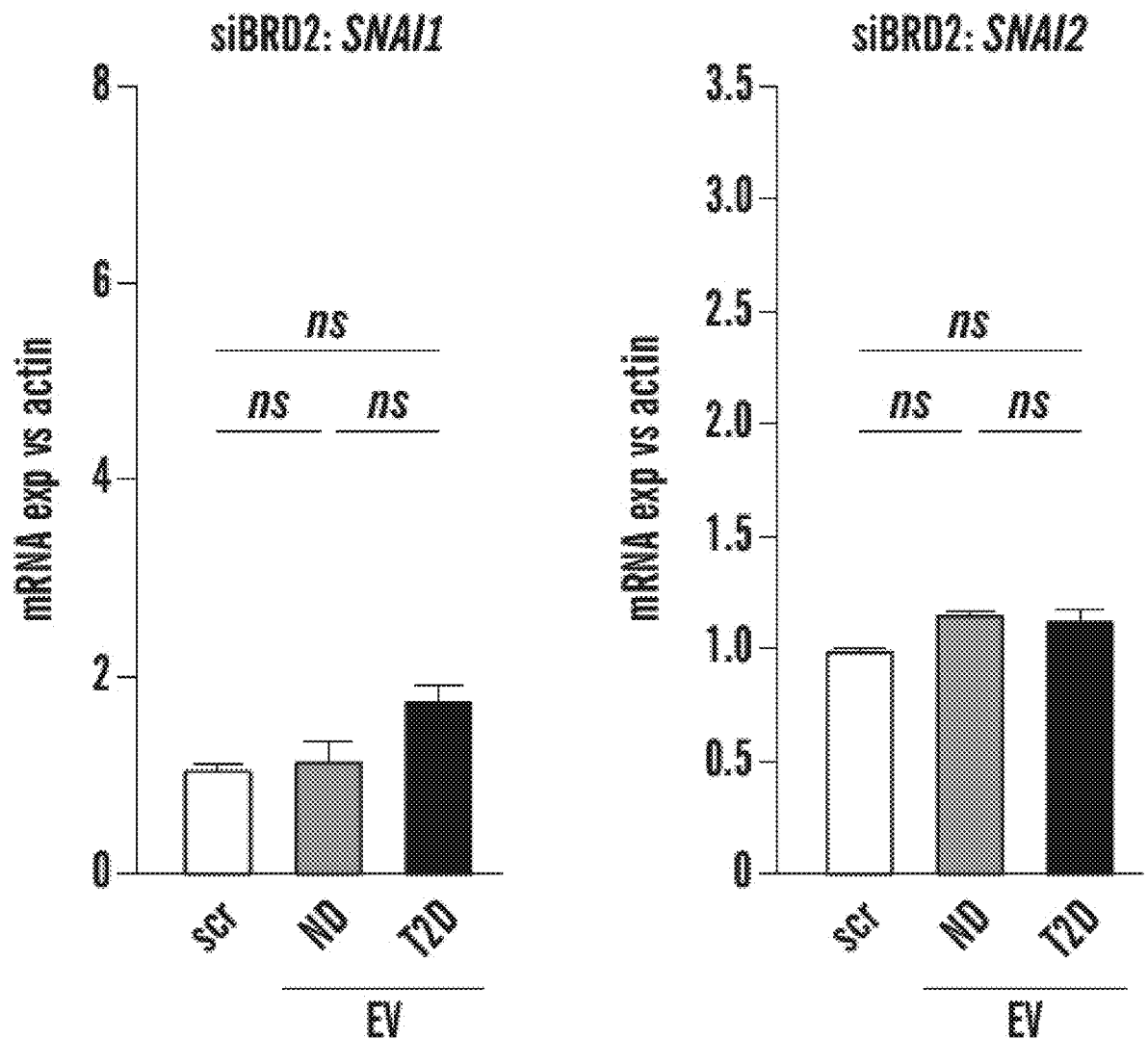
Figure 3F:
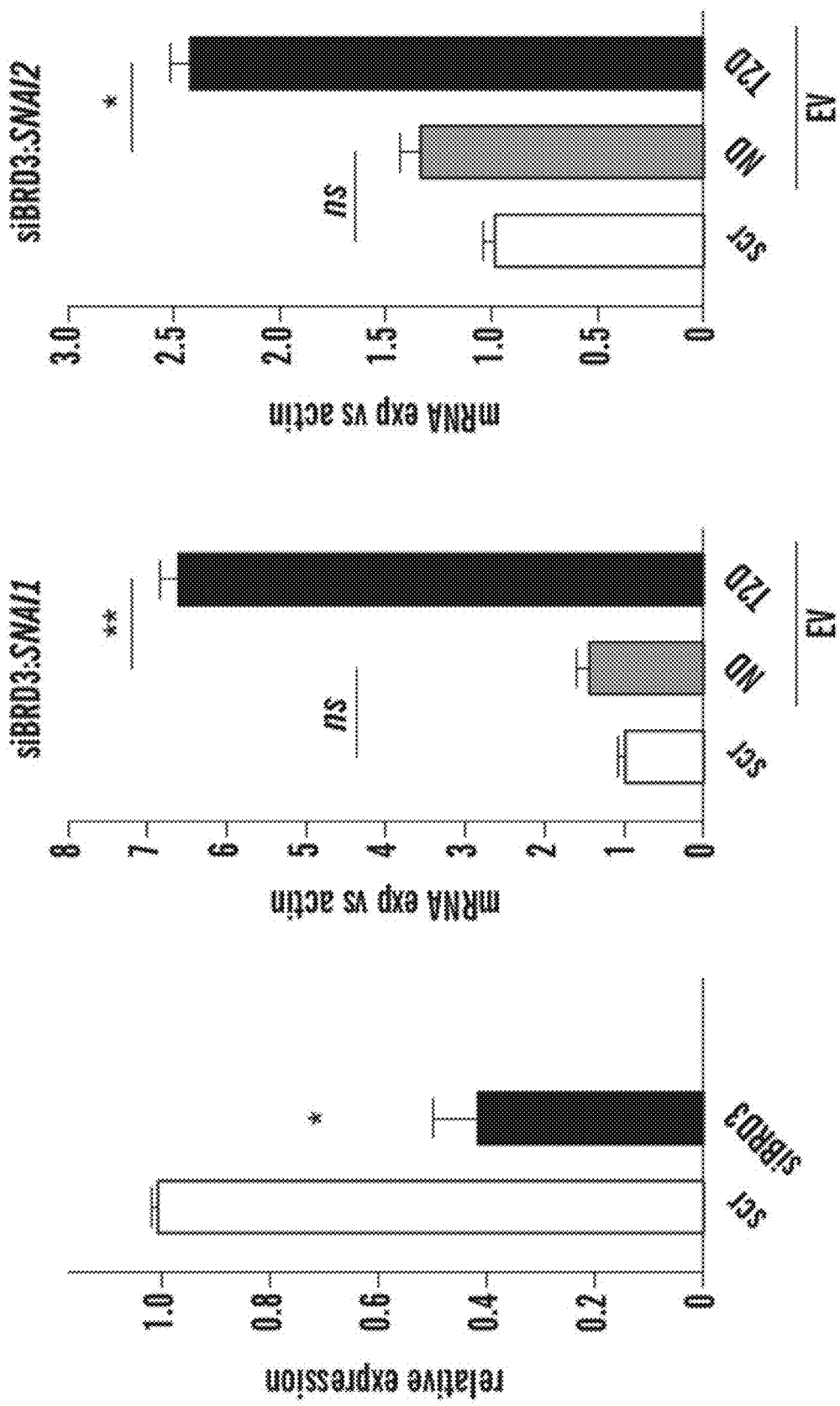
Figure 3F:
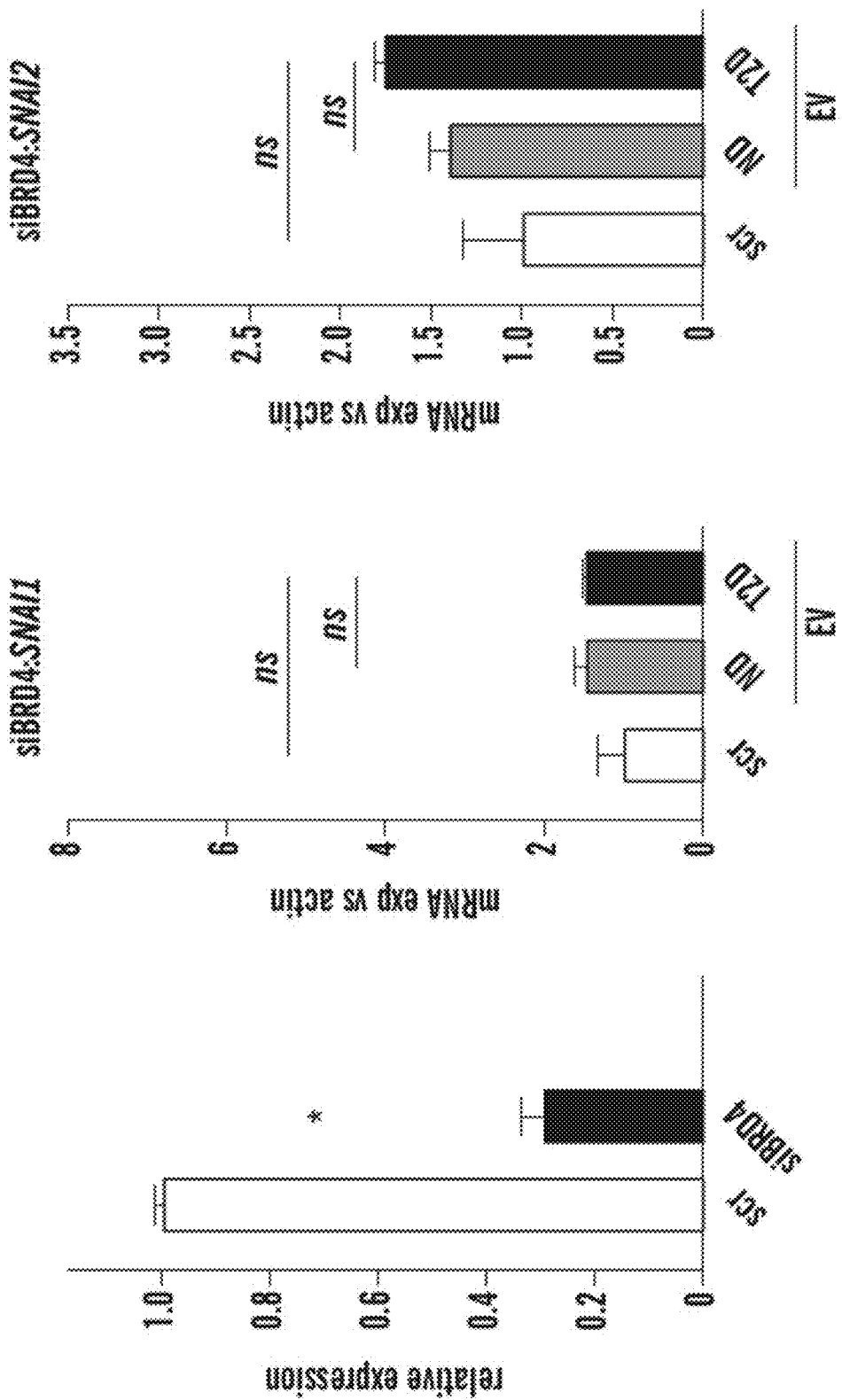

It was previously established that critical pathways that promote breast cancer aggressiveness and EMT are controlled by the somatic BET (bromodomain and extraterminal domain) protein family (18,19), although only BRD4, and not BRD2 or BRD3, is required for cellular migration in breast cancer (18,20) and prostate cancer models (21). Therefore, the BET dependence of exosome induction of selected EMT genes was tested in MCF7 cells. Upon siRNA knockdown of BRD2 and BRD4, but not BRD3, the exosomes purified from ND or T2D adipocytes lost their ability to increase SNAIL and SNAI2 (FIG. 3F). Thus, exosome signaling to these EMT target genes requires the BET proteins BRD2 and BRD4 as essential effectors.

Figure 9A:
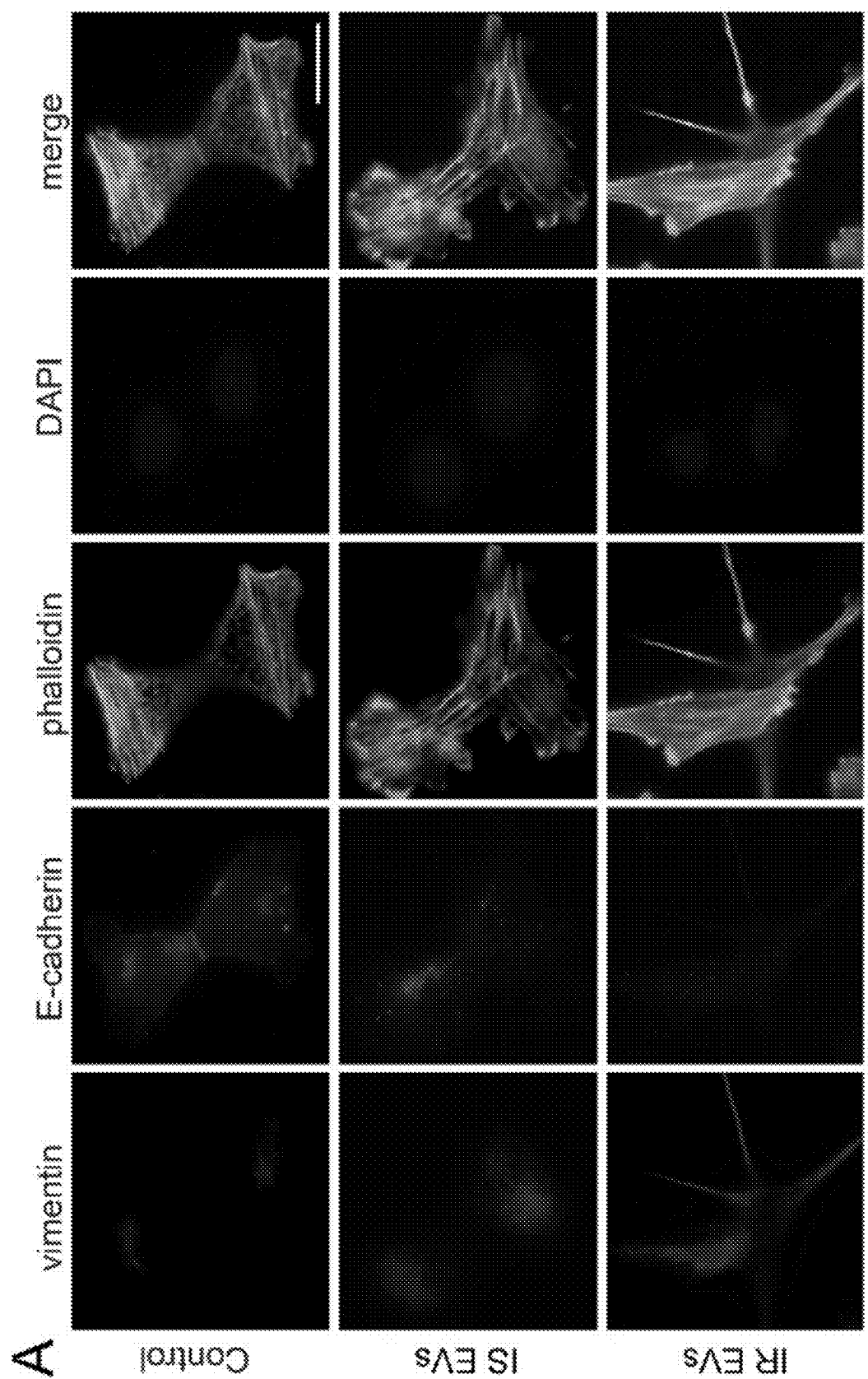
FIGS. 9A-9D depict EMT induction in murine 4T1 cells treated with EVs from IS vs IR murine adipocytes. Murine 3T3-L1 adipocytes were differentiated from pre-adipocyte fibroblasts as published (24), treated with 250 pM murine TNFα, as specified to induce insulin resistance (9), then adipocyte conditioned media was used as the source of EVs.
Figures 9B, 9C, 9D:
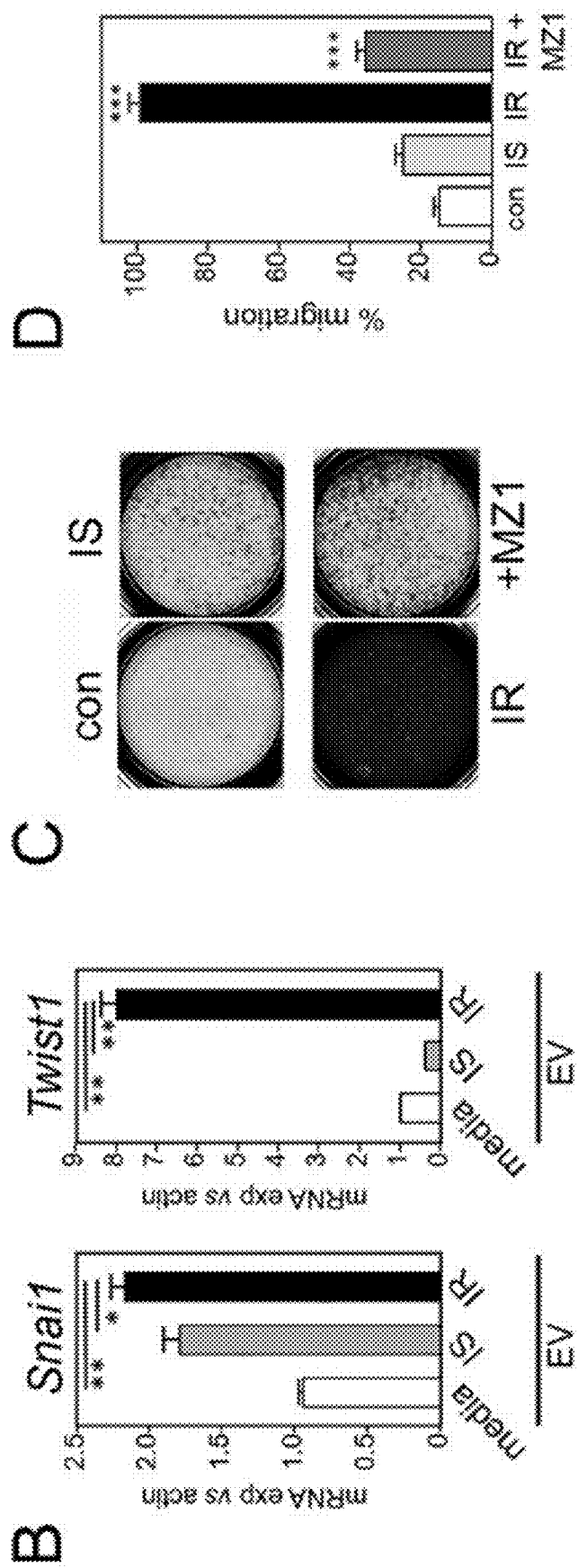

The inventors then tested whether the same functional relationships held for an entirely different system: 10 murine 4T1 cells (22), a model for highly metastatic, triple-negative breast cancers (23). Murine 3T3-L1 pre-adipocytes differentiated to mature adipocytes (24) were used as the source of exosomes, then mature adipocytes with murine TNFa were treated to induce insulin resistance as above. As in the human system, exosomes from mouse IR adipocytes induced expression of mesenchymal proteins and reduced epithelial proteins in 4T1 cells, compared to untreated control or exosomes from IS adipocytes (FIG. 9A). As before, exosomes from IR adipocytes induced EMT genes (FIG. 9B) and greater migration (FIGS. 9C-9D) in 4T1 cells than did exosomes from IS adipocytes. As BRD4 is a critical regulator of cellular migration in several human breast cancer cell models, including MCF7, SUM149PT and MDA-MB-231 (18), the BRD4-selective PROTAC degrader MZ-1 (25), which ablates prostate cancer cell migration (21), was used to inhibit 4T1 cell migration. As expected, MZ-1 effectively ablated 4T1 migration provoked by treatment with exosomes from IR adipocytes (FIG. 9D).

Figure 4A:
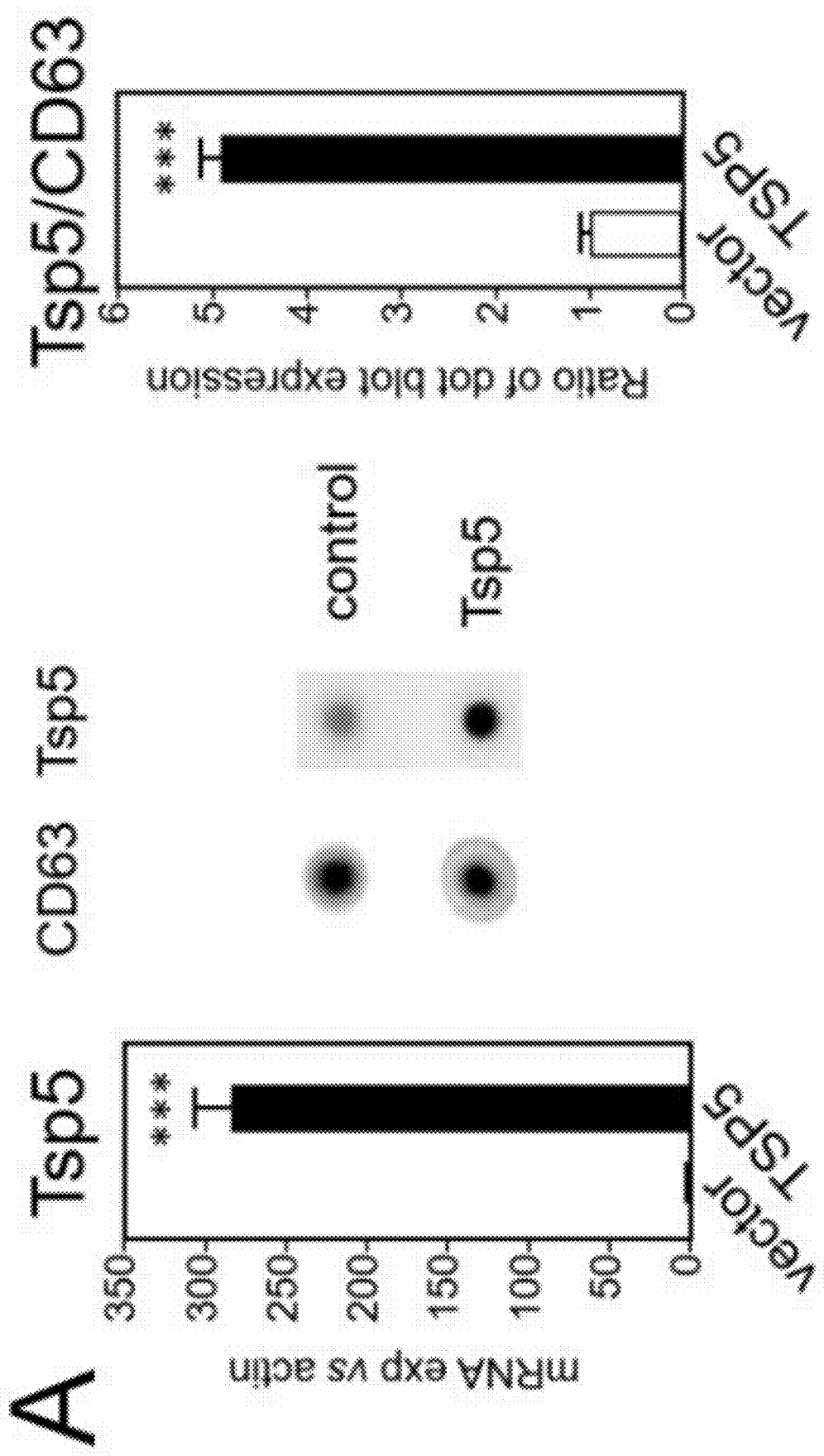
FIGS. 4A-4E demonstrate that TSP5 protein drives expression of EMT phenotypes. Pre-adipocytes were transduced with TSP5-expressing lentivirus and differentiated to mature adipocytes as above.
Figure 4B:
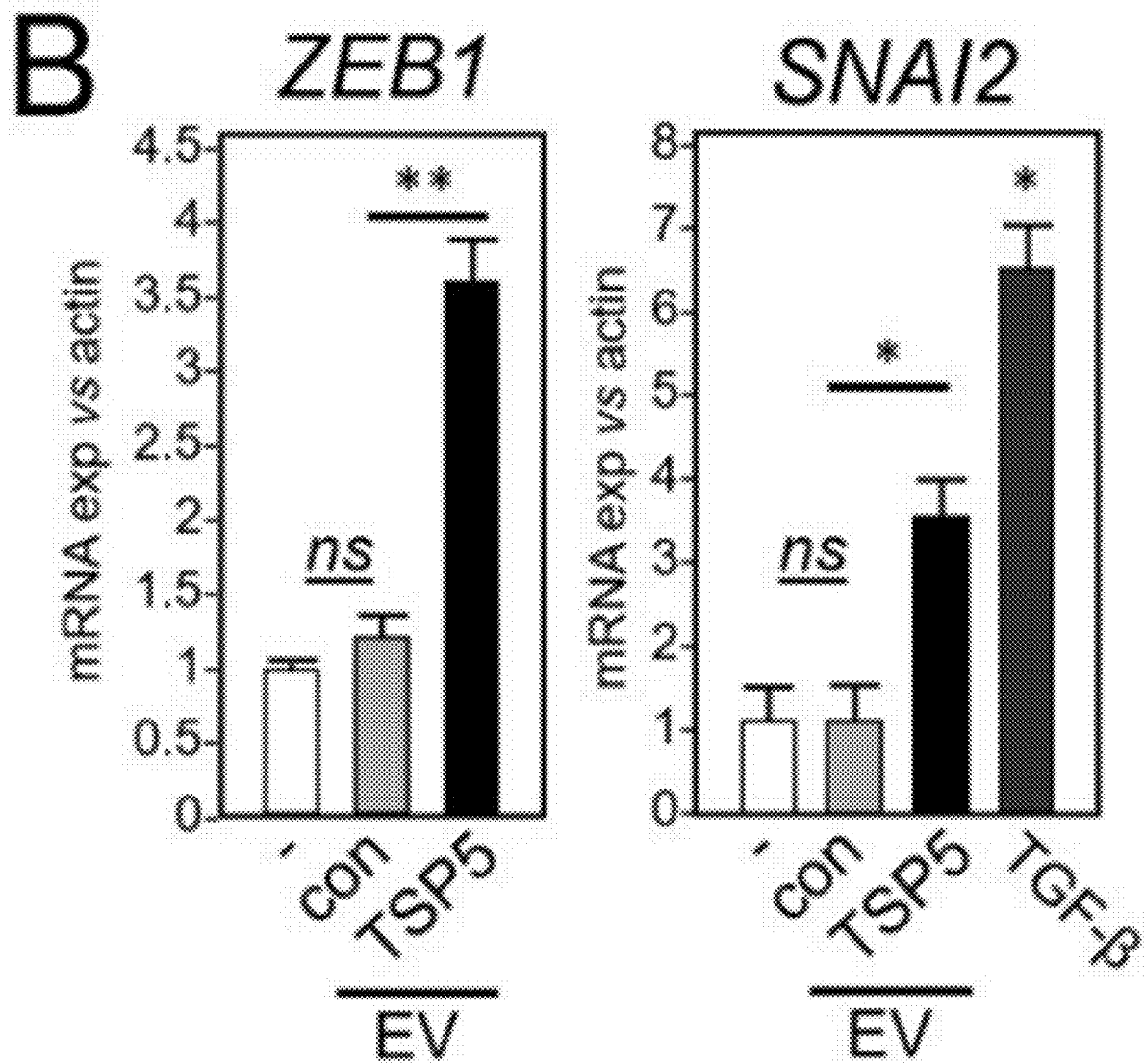
Figure 4C:
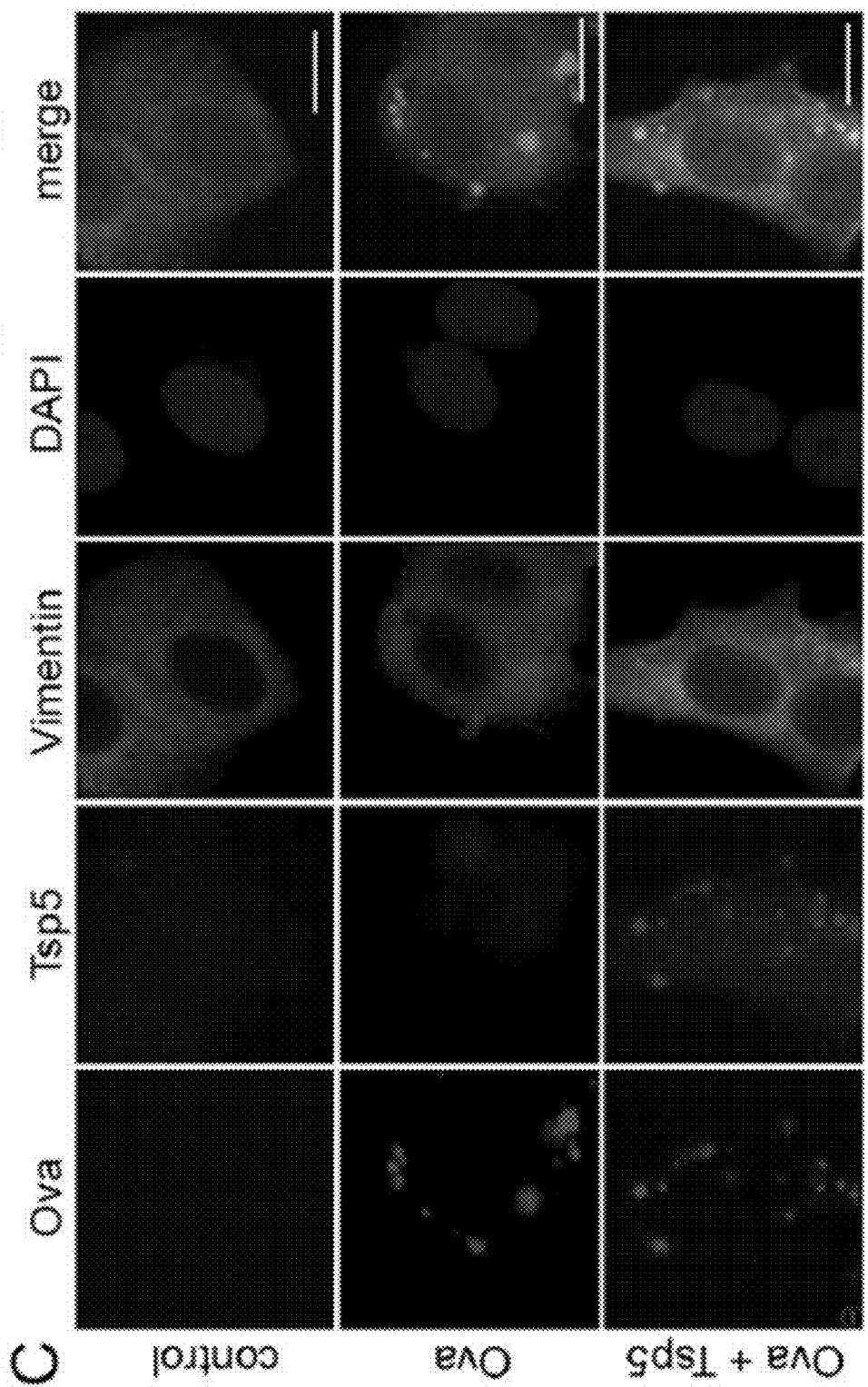

Compared to Those From Insulin-Sensitive Adipocytes, Exosomes From Insulin-Resistant Adipocytes Carry More TSP5, Which Induces Several EMT genes Both ND and T2D types of exosomes contained proteins of known importance for the TME. The top differentially represented hit was thrombospondin-5 (TSP5, encoded by COMP; FIG. 3E), which is associated with cancer progression (26,27), suggesting that TSP5 is critical for exosome effector function. To test the role of TSP5, the inventors transduced human primary pre-adipocytes with lentivirus overexpressing TSP5, then differentiated the cells into adipocytes and purified exosomes from conditioned media. The inventors first confirmed increased expression of TSP5 mRNA in the adipocytes, and increased protein loading into exosomes using the exosome marker CD63 as a control (FIG. 4A), then tested EMT gene responses in MCF7 cell readouts. As expected, TSP5-enriched exosomes significantly increased transcription of ZEB1 and SNAI2 readout genes compared to control (FIG. 4B). To prove that exosomes deliver TSP5 to MCF7 cells, the inventors loaded synthetic, cationic lipid vesicles with recombinant human TSP5 and identified them with fluorescently labeled ovalbumin. Imunofluorescence showed that TSP5-loaded exosomes indeed delivered their payload to MCF7 cells to induce vimentin expression (FIG. 4C).

Figures 4D, 4E:
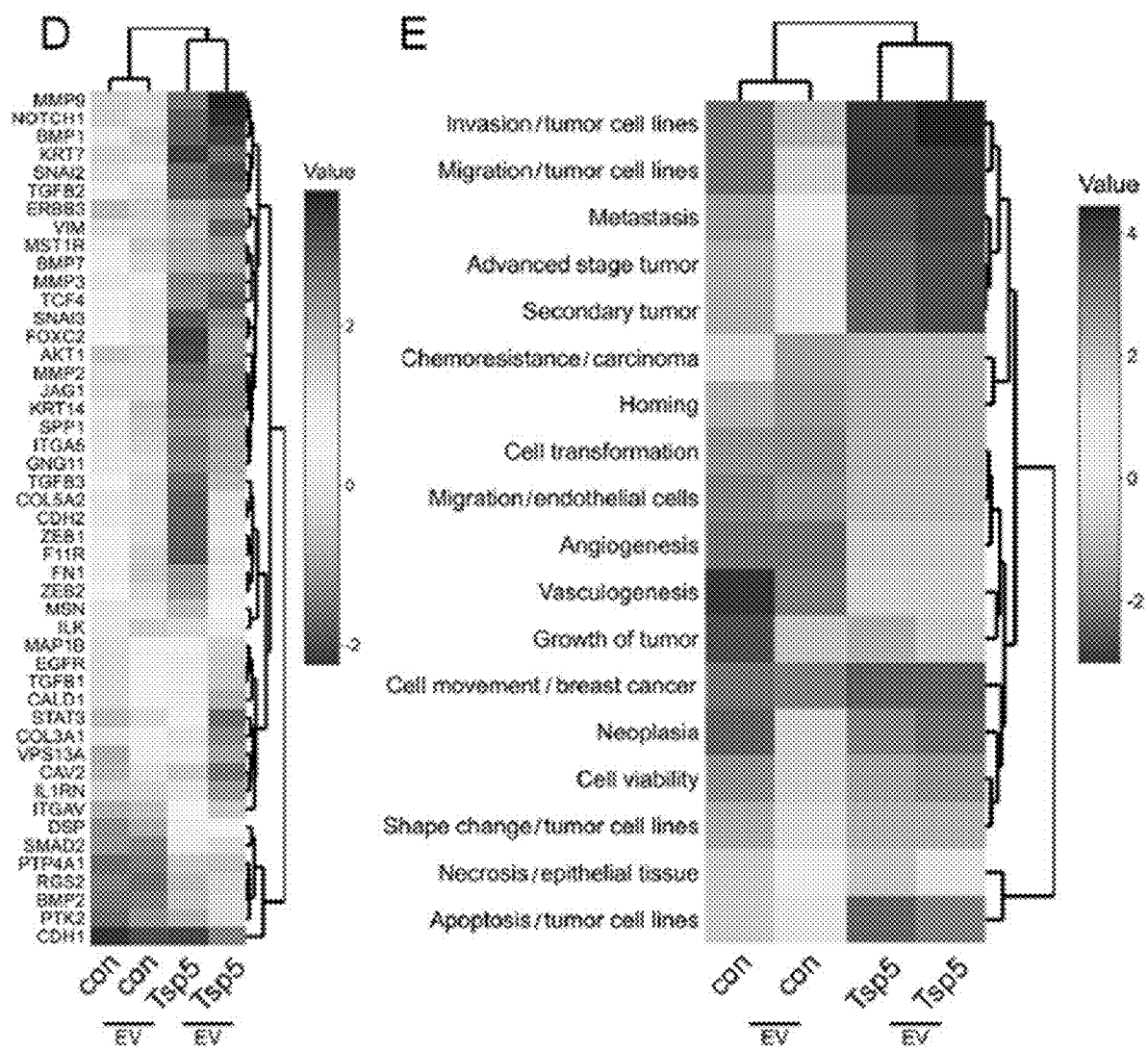
Figures 10A, 10B:
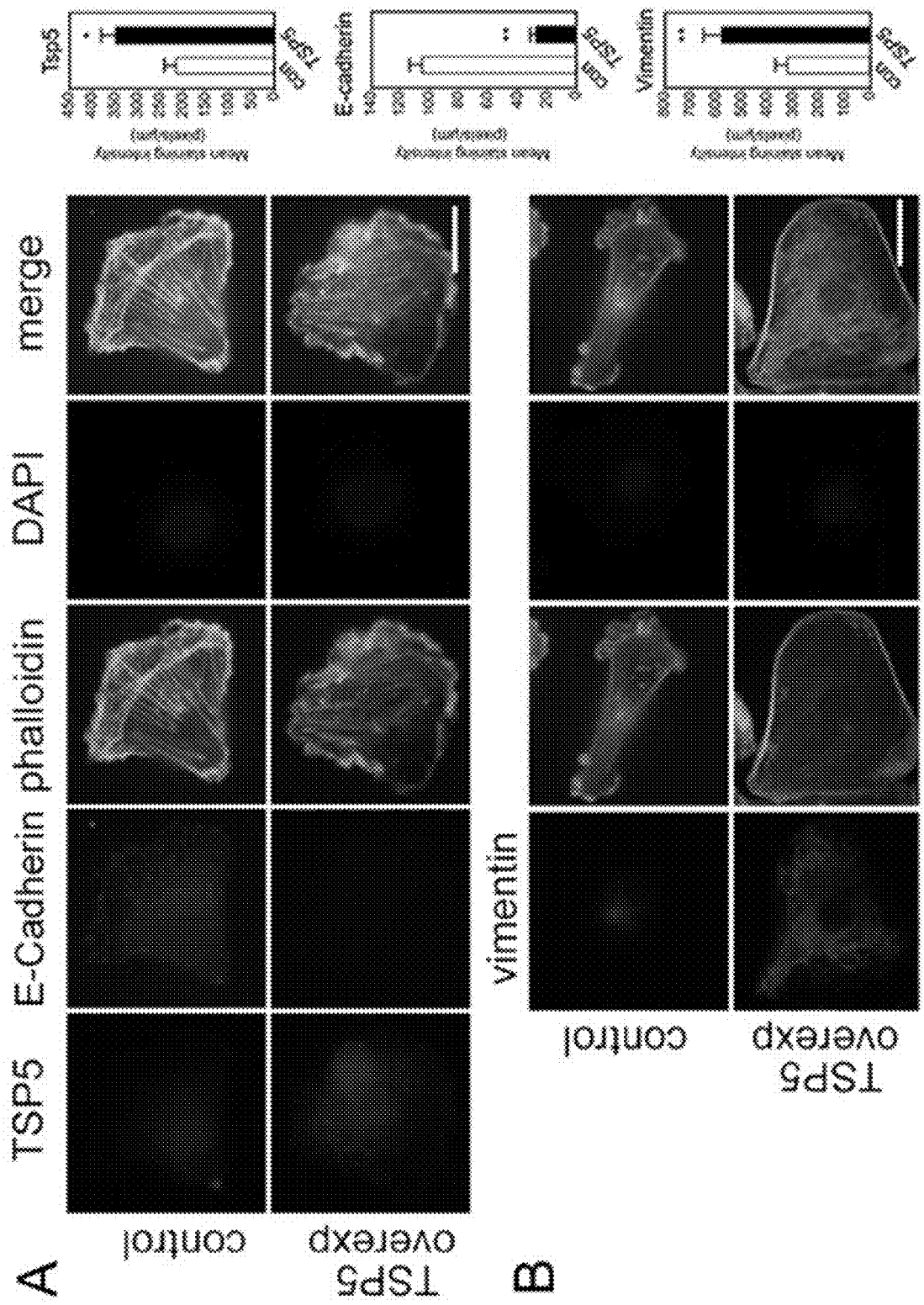
FIGS. 10A-10B demonstrate that TSP5 overexpression in MDA-MD-231 cells reduces expression of epithelial marker protein E-cadherin and increases expression of mesenchymal marker protein Vimentin.
Figures 11A, 11B, 11C:
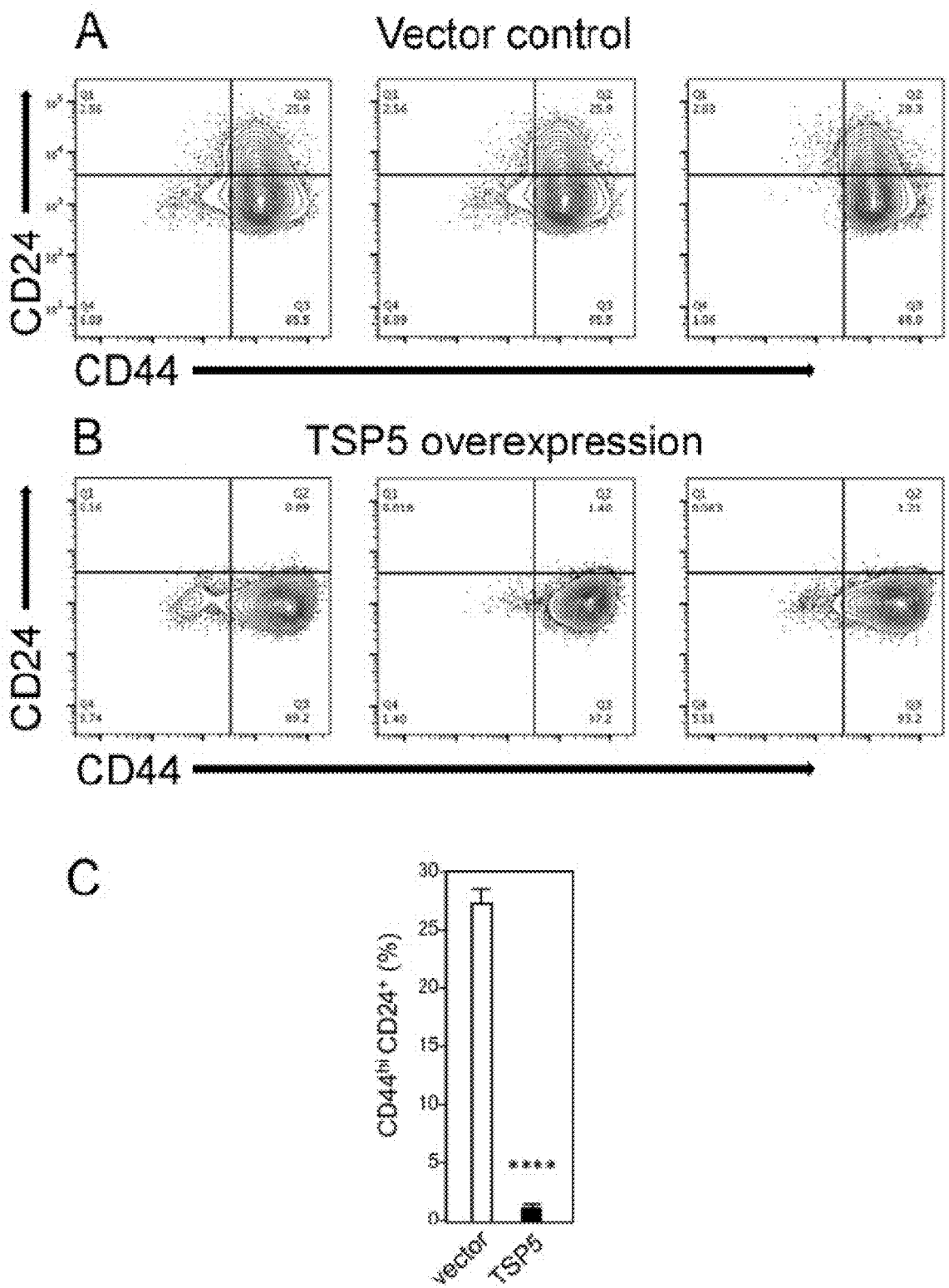
FIGS. 11A-11C demonstrate that TSP5 (COMP) overexpression in MCF10A cells increased CSC markers. TSP5 overexpression induced a high ratio of CD44hi/CD24 expression as determined by flow cytometry, consistent with enhanced invasion and metastatic potential. (n=3; ****, P<0.0001).

Additionally, exosomes released from TSP5 lentivirus-transduced, primary adipocytes (ABM-007) induced expected transcriptional changes by EMT array, whereas control exosomes from the same adipocytes transduced with lentivirus vector control did not (FIG. 4D and data not shown). Here, MMP9 was the top ranked gene. Consistent with previous results, pathway analysis TSP5-loaded exosomes increased signaling associated with invasion, migration and metastasis, and decreased pathways associated with cell death (FIG. 4E and data not shown). The inventors also transfected MDA-MB-231 cells with plasmids for overexpression of recombinant, V5 epitope-tagged TSP5 and confirmed by immunofluorescence that the epithelial marker E-cadherin was decreased (FIG. 10A) and the mesenchymal marker vimentin was increased (FIG. 10B) Additionally, the inventors used flow cytometry of CD24 and CD44 surface markers (28) to show that forced expression of TSP5 shifted non-malignant breast epithelial MCF10A cells toward a more mesenchymal-like (CD44hi/CD24lo) phenotype (FIGS. 11A-11B). These results confirm that forced expression of TSP5 is necessary and sufficient to induce EMT-like phenotypic changes in human breast cancer cell models, without ruling out the possibility that native exosomes released by adipocytes harbor as-yet uncharacterized proteins, enzymes, RNAs or metabolites that provoke similar shifts (7).

Figures 12A, 12B, 12C, 12D:
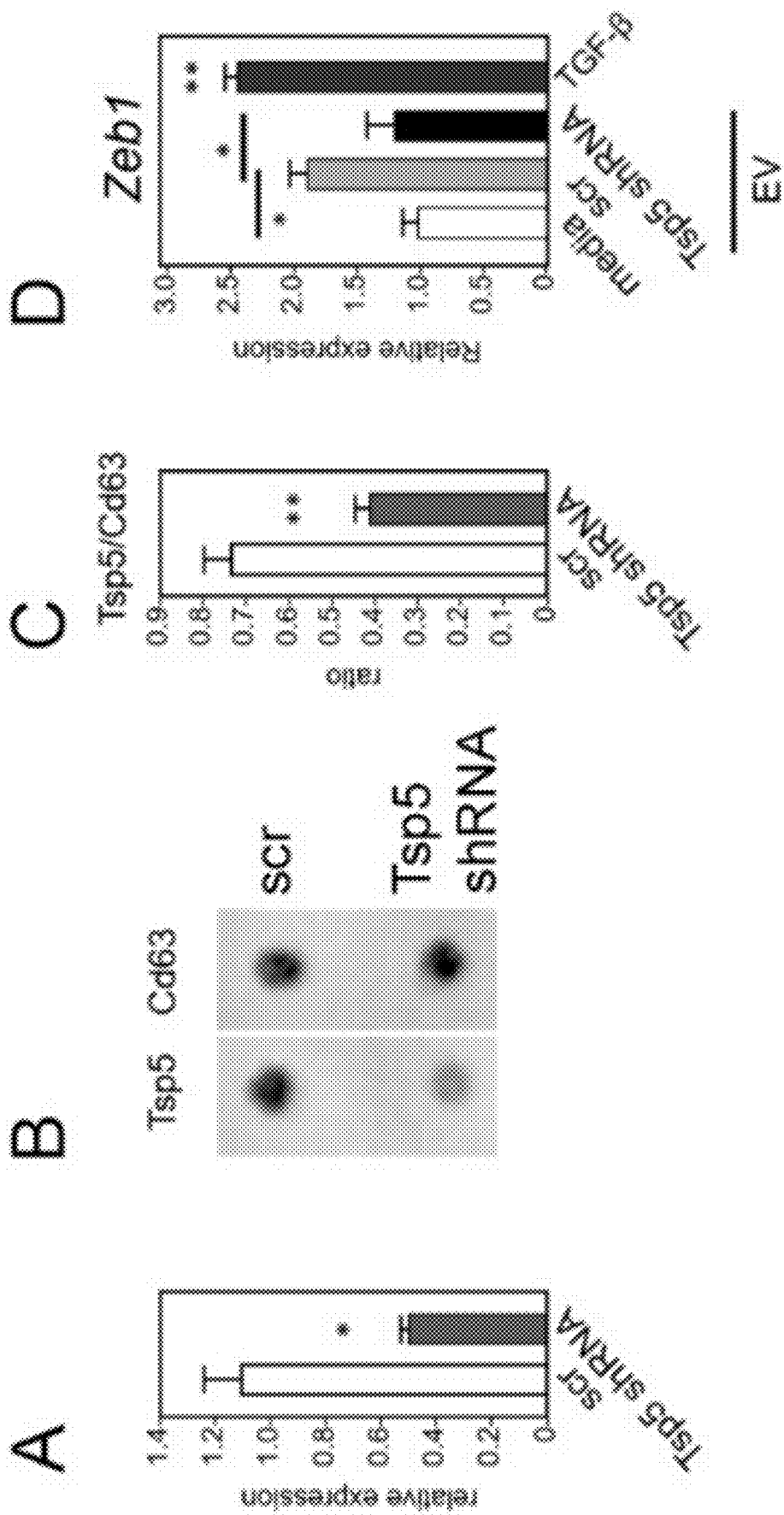
FIGS. 12A-12D demonstrate that TSP5 knockdown in 3T3-L1 adipocytes reduced the Tsp5 content of mature adipocyte exosomes, and correspondingly reduced exosome induction of selected EMT gene, Zeb1. Murine 3T3-L1 pre-adipocyte fibroblasts were exposed to shRNA against murine Tsp5, then differentiated into mature adipocytes as above. Conditioned media of these cells was used as the sources of exosomes for experiments with 4T1 cells.

As a negative control, the inventors knocked down Tsp5 in 3T3-L1 pre-adipocytes with shRNA and confirmed that knockdown ablated the ability of exosomes purified from mature adipocytes to induce several EMT genes in 4T1 cells (FIG. 11), including SNAI1, NOTCH1, JAG1, ZEB1 and MMP3 (FIGS. 12A-12B). Exosomes from the TSPS knockdown adipocytes no longer induce canonical cancer pathways upregulated by IR exosomes (ILK, ERK/MAPK, HGF and actin cytoskeleton signaling; FIG. 12C). Other IR exosome-induced genes (such as SERPINE1 and MAP1B) were TSP5-independent (FIG. 12B), as were other canonical cancer pathways (such as FAT10 cancer signaling, TGFβ signaling, and STAT3 signaling; FIG. 12C).

Figure 5:
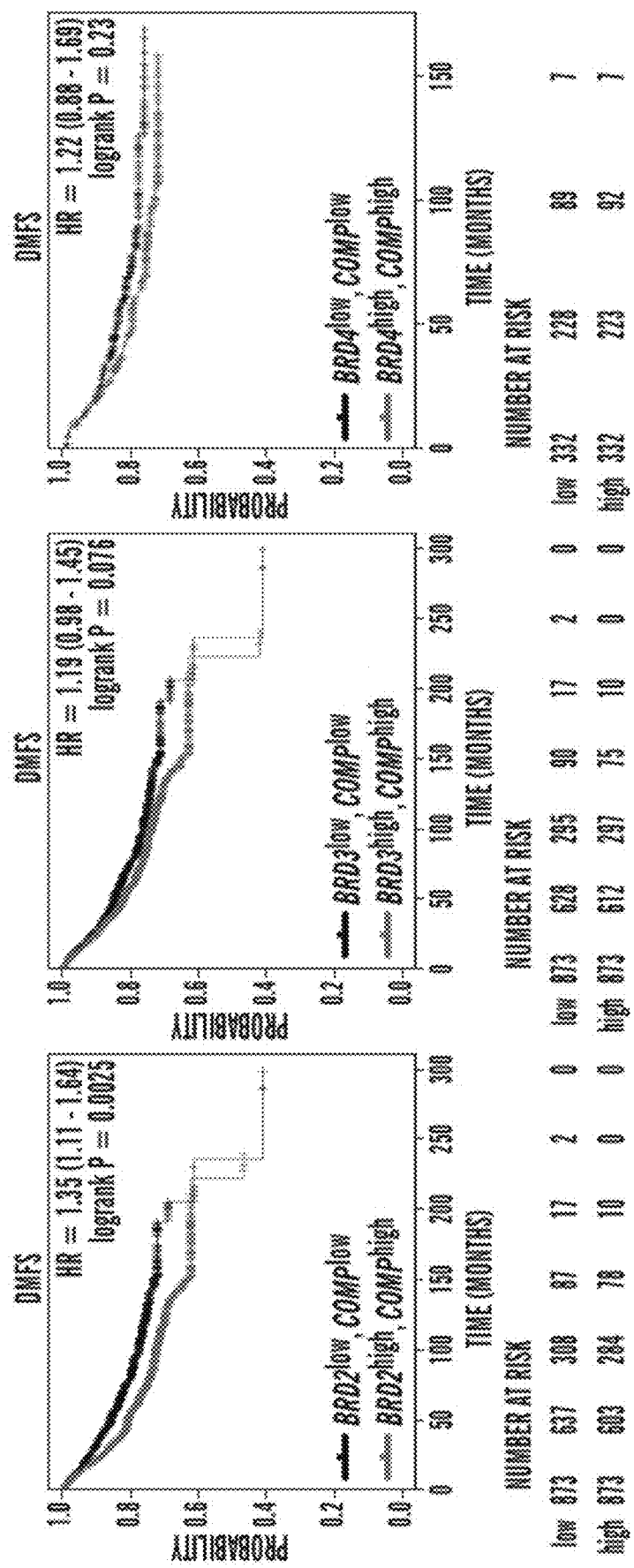
FIG. 5 depicts Kaplan-Meier curves of distant metastasis-free survival of breast cancer patients, calculated from TCGA data. The level of expression of COMP, the gene encoding TSP5, was assessed for association with distant metastasis-free survival (DMFS) in breast cancer patients in co-expression with each of the three somatic BET bromodomain genes BRD2, BRD3 or BRD4. Expression groups of equal size were characterized as high (grey) or low (black) for each gene, and 10 joint probabilities were computed for 873 patients per group. Survival times are shown in months; hazard ratios (HR) and confidence intervals (in brackets) are shown for each pair of genes. A statistically significant, 35% increased risk of distant metastasis over 25 years was determined for high co-expression of BRD2 and COMP, and a 19% increased risk for high co-expression of BRD3 and COMP. There was a trend to DMFS for high BRD4 and COMP, but the difference did not reach statistical significance for 332 patients per group.

Co-Expression of Genes Encoding TSP5 and BET Proteins Associates with Decreased Distant-Metastasis-Free Survival in Breast Cancer Cohorts Finally, the inventors examined distant metastasis-free survival (DMFS) in cohorts of breast cancer patients with high or low expression of COMP, the gene encoding TSP5, co-expressed with high or low levels of each of the three BET bromodomain genes BRD2, BRD3 or BRD4 (FIG. 5). As expected, higher co-expression of COMP and a BET gene was associated with reduced DMFS, with the strongest effect for BRD2. Specifically, a statistically significant, 35% increased risk of distant metastasis over 25 years was observed for high co-expression of BRD2 and COMP, and a 19% increased risk for high co-expression of BRD3 and COMP. There was a trend for reduced DMFS for high co-expression of BRD4 and COMP, but the difference did not reach statistical significance for 332 patients per group. These findings reaffirm the importance of testing the functions of all three somatic BET genes (19) in obesity-related cancer, not just BRD4, which is commonly assumed to be the sole important player (29,30).

Discussion

Population studies over twenty years have convincingly implicated cardiometabolic risk factors in incidence and progression of obesity-driven cancers, including breast cancers (31-33). Numerous hormones, metabolites, cytokines and tissue structural properties that change in concert with obesity, in both humans and animal models, have gained attention as potential mechanisms that link obesity and cancer. However, identification of the most important causal elements has been difficult. Seeking to leverage ex vivo and in vitro models, many investigators continue to test murine adipocytes against human breast cancer cell lines, in co-culture, conditioned media or organoid experiments, where species differences may complicate interpretation. Furthermore, the few reports that use human adipocytes often derive preadipocyte progenitors from normal volunteers and ignore insulin resistance. The inventors determined that human breast cancer cell lines provide a useful ex vivo readout to assay factors produced by human primary adipocytes. The inventors considered the metabolism of the adipocyte as the independent variable.

High-throughput, cellular proliferation assays are widely used for discovery of novel biochemical activators or inhibitors, yet these techniques yield limited information. The inventors focused instead on pathway analysis of transcriptionally induced EMT genes, which requires 3-5 days, rather than simpler, overnight proliferation assays. This approach enabled discovery of novel pathways important for tumor progression that might be missed with a more convenient assay. Although systemic metabolism of the patient clearly plays a major role in the risk of breast cancer progression (34), the adipocyte contribution to the local signaling in the TME demands further study.

IPA shows gene regulation pathways associated with tumor cell aggressiveness (invasiveness, migration, angiogenesis) are upregulated by insulin-resistant cell-derived exosome payloads compared to those from insulin-sensitive cells. Angiogenesis pathways are also coupled to hypoxia in adipose tissue in obesity (37-39), and the increased expression of such genes as NOTCH1, SNAI1, SNAI2, SERPINE1, COL1A2, EGFR and those associated with the HIF1α pathway, as shown here, suggest that insulin-resistant and T2D-derived adipocyte exosomes may mediate differences in the breast TME of patients with metabolic disease, promoting tumor vascularization as the malignant cell clones undergo expansion. However, breast tumor cell invasiveness and migration mechanisms appear uniquely to require NOTCH1 and BRD4 signaling (18).

The present results implicate exosome proteins from IR adipocytes in tumor aggressiveness associated with EMT and cancer stem cell signatures. Results are borne out in breast cancer patient cohorts with long term follow-up (FIG. 5). These conclusions are consistent with an extensive clinical and population literature that has implicated patient metabolism in risk of breast cancer incidence and progression. Furthermore, adipocyte-origin, circulating exosomes might be suitable as non-invasive, liquid biopsy biomarkers to assist clinical decision making for breast cancer patients at risk for progression. The present insights into exosome communication among adipocytes and tumor models of divergent hormone status indicate that patient metabolism influences progression risk across breast cancer subtypes, through microenvironment mechanisms independent of hormone signaling.

Materials and Methods

Cell Lines

Cell lines, including MCF7 (HTB-22), MDA-MB-231 (HTB-26), T47D (HTB-133) and 3T3-L1 (CL-173), were obtained from the American Type Culture Collection (ATCC). Human primary pre-adipocytes were obtained and differentiated in Boston University's Adipose Tissue Biology and Nutrient Metabolism Core.

Reagents

Unless otherwise specified, chemicals and biochemicals were from Sigma-Aldrich. Differentiation reagents for conversion of murine 3T3-L1 fibroblasts to mature adipocytes were dexamethasone (D8893-1MG), 3-isobutyl-1-methylxanthine (IBMX, 17018) and insulin (10516). Reagents used in experiments for transfer of exogenous TSP5 to target cells were recombinant COMP/TSPS (SRP6457), Pierce™ Protein Transfection Reagent (89850, Thermo Scientific), ovalbumin, and Alexa Fluor™ 647 conjugate (034784, Thermo Scientific). Paraformaldehyde solution (AAJ19943K2, Thermo Scientific) and 4',6-diamidino-2-phenylindole dihydrochloride (DAPI, FluoroPure grade; D21490, Thermo Scientific) were used to fix and stain the nuclei.

Gene expression analysis by RT-PCR was performed using TaqMan™ master mix (Thermo Fisher, 4369510). The human gene probes were: SNAP (Hs00195591 ml), SNAI2 (Hs00950344 ml), CDH1 (Hs01023895 ml), COMP (Hs00164359 ml), ACTB (Hs00357333 gl). VIM (Hs00958111 ml), ZEB] (Hs01566408 ml), TWIST1 (Hs01675818 sl), JAG1 (Hs01070032 ml), NOTCH1 (Hs01062014 ml), TGFB1 (Hs00998133 ml), BRD2 (Hs01121986 gl), BRD3 (Hs00978972 ml) and BRD4 (Hs04188087 ml).

The mouse gene probes were: Snail (Mm00441533 gl), Vim (Mm01333430 ml), Cdhl (Mm0 1247357 ml), Comp (Mm00489490 ml), Twist1 (Mm00442036 ml) and Actb (Mm02619580 gl), Zeb1 (Mm00495564 ml) and Epcam (Mm00493214 m1).

Antibodies

Antibodies to CD63 (ab216130), TSPS (ab74524), V5 tag (SV5-Pk1) (ab27671) and vimentin (monoclonal ab8978) were purchased from Abcam. Antibodies to E-cadherin (4A2, mouse mAb 14472), vimentin (D21H3, rabbit mAb 5741) and N-cadherin (D4R1H, rabbit mAb 13116) were obtained from Cell Signaling Technology. Filamentous actin (F-actin) was stained using either Alexa Fluor™ Phalloidin probes 488 nm (A12379), 568 nm (A12380) or Plus 647 (A30107) from Thermo Fisher. Mouse or rabbit Alexa Fluor Plus secondary antibodies were purchased from Thermo Fisher and used for immunofluorescence imaging.

Differentiation of 3T3-L1 Pre-Adipocytes

3T3-L1 pre-adipocytes were cultured in Dulbecco's modified eagle medium (DMEM) containing 4.5 g/L glucose, L-glutamine and sodium pyruvate) supplemented with 10% fetal bovine serum (FBS), 100 units/mL penicillin, 10 µg/mL streptomycin (all from Corning) until confluence, then incubated in the same medium for an additional 2 days. Differentiation was induced by addition of 1 µM dexamethasone, 0.5 mM IBMX, and 1.67 µM insulin for 3 days, at which time the 20 medium was replaced with growth medium containing 0.41 µM insulin. After differentiation, cells were treated with 1 nM recombinant mouse TNF-a (Abcam, ab9740) for 24 hours to induce insulin resistance.

Differentiation of Primary Human Adipocytes

Samples were de-identified and not linked to any protected information. All subjects provided informed consent for participation. The protocol was approved by Institutional Review Board of Boston University Medical Center. To obtain pre-adipocytes, subcutaneous fat tissue was obtained by BNORC from subjects undergoing bariatric surgery. Adipose stromal cells (ASC) were isolated as previously described (36). Briefly, minced tissue was treated with collagenase solution (1 mg/mL HBSS) (Type 1, Worthington Biochemical, Lakewood NJ) at 37° C., shaken at 100 rpm for 2 hours. The digested tissue was filtered through a 250 µm mesh (Component Supply, Inc. Smithville Hwy, Sparta, TN). Cells in the flow through were centrifuged at 500×g for 10 min at room temperature. The red blood cells in the cell pellets were lysed (0.154 mM NH4C1, 10 mM KH2PO4 and 0.1 mM EDTA, pH 7.3). Then, washed cells were plated using alpha MEM Media (Gibco Thermo Fisher Scientific, Waltham MA) with 10% FBS (Gemini Bio Products, West Sacramento, CA), 100 units/mL penicillin, 10 µg/mL streptomycin (Pen/Strep) (Corning, Corning NY). Differentiation of ASCs to adipocytes was performed in serum-free media using chemicals and reagents purchased from Sigma-Aldrich (St. Louis, MO) unless otherwise noted. Complete differentiation media (CDM) was made in DMEM/F12 (GIBCO) with 25 mM NaHCO3 and Pen/Strep containing 33 µM D-(+)-biotin, 17 µM pantothenate, 10 µg/mL transferrin, 100 nM dexamethasone, 100 nM insulin, 1 µM rosiglitazone (Calbiochem), 2 nM 3,3',5-triiodo-L-thyronine (T3) and 0.5 mM IBMX. Differentiation was initiated two days post-confluence and CDM was replenished every 2-3 days. After 7 days, CDM was removed and the cells were fed with maintenance media: DMEM/F12 (GIBCO) with 25 mM NaHCO3 and Pen/Strep containing 33 µM D-(+)-biotin, 17 µM pantothenate, 10 µg/mL transferrin, 10 nM dexamethasone and 10 nM insulin.

Negative Control Exosomes From Undifferentiated Adipose Stromal Cells

As a rigorous control to confirm the mature adipocyte origin of the biologically active exosomes, the inventors used the 2-dimensional culture of primary ASCs from which adipocytes are differentiated by the standard cocktail (above) and omitted a key chemical required for differentiation: rosiglitazone. In this case, without the consequent activation of PPARγ, mature adipocytes do not form, yet pre-adipocyte fibroblasts, endothelial cells and any other ACS cells remain represented in the culture. Conditioned media from this pre-adipocyte culture, where differentiation was blocked, was used as the source of exosomes, which were purified and added to the MCF7 cultures.

Induction of Insulin Resistance

Treatment of mature, fully differentiated, primary adipocytes ex vivo with low concentrations (250 pM) of the pro-inflammatory cytokine tumor necrosis factor alpha (TNFa) is well established to ablate insulin-sensitive glucose transport and induce phosphorylation of Akt and other molecular changes. Human primary adipocytes were treated with 250 pM recombinant human TNFa (Abcam, ab9642), and 3T3-L1 adipocytes were treated with 1 nM recombinant ouse TNFa (Abcam, ab9740), overnight to induce insulin resistance.

Exosome Isolation

The conditioned media of both ND or T2D adipocytes yielded between $8.0 \times 10^8$ and $1 \times 10^9$ exosomes per mL, from which we purified and concentrated exosomes as follows. Conditioned media (typically 10 mL) was centrifuged at 300×g for 10 min in a 15 mL conical tube to remove cells and debris. The supernatant was transferred to a new 15 mL conical tube and further centrifuged at 16,000×g for 30 min to remove additional debris. This supernatant was then transferred to an Amicon Ultra-15 (Millipore-Sigma; REF-UFC910008) 100K centrifugal filter and centrifuged at 4,500×g for 15 min to concentrate the material to 1 mL final volume. To precipitate exosomes, 1 mL of this concentrated, conditioned media was added to Exo-spin Buffer reagent (Cell Guidance Systems; #EX06) in a 2:1 ratio (sample:buffer; v:v) and incubated overnight at 4° C. The sample was then centrifuged at 16,000×g for 1 hour at 4° C. to pellet the exosomes. The supernatant was discarded and the pellet was re-suspended in 100 µL PBS (Cell Guidance System; LOT0619; EX-P10) for further separation of exosomes from other exosomes using Exo-spin columns. These spin columns work on the principle of size exclusion chromatography with separation of particles based on diameter. The columns are packed with spherical beads, with a 30 nm pore size. The space between the pores is such that the eluate contains exosomes with a size range of 30 nm-200 nm. The Exo-spin (Cell Guidance System; LOT0720) column was equilibrated for 15 min at room temperature before use. The column was calibrated twice with 250 µL PBS and centrifuged at 50×g for 10 sec. Then, 100 µL of re-suspended total exosome sample was added to the top of the column, which was then centrifuged 20 at 50×g for 60 sec and the flow through was discarded. The column was then transferred to a new 1.5 mL centrifuge tube, whereupon 200 µL PBS was applied to the column, which was then centrifuged at 50×g for 60 sec to elute 200 µL of final, pure exosomes for downstream functional assays.

Exosomes were also purified using a Total isolation kit (Thermo Fisher Scientific) and purified by size exclusion chromatography on a qEV Original column, using an Automatic Fraction Collector (AFC, serial number: V1-0395, IZON) and identified for similar functional outcomes in downstream assays. The size distribution and concentration of exosomes were always determined before each biological experiment using a NanoSight NS300 system (Malvern Panalytical). Day-to-day variation in exosome yields across adipocyte cultures was <10%, and TSP5 knockdown or overexpression adipocytes yielded exosome numbers within this range. For each experiment, exosome counts were always normalized after NanoSight quantitation such that equal numbers were added to cell wells in each experiment and across 10 replicates.

Glucose Transport Assay

To measure glucose uptake in cells, the Glucose Uptake-Glo™ Assay (J1341, Promega) was used as outlined in the manufacturer's protocol. This is a plate-based, bioluminescent method for measuring glucose uptake by living cells, based on the detection of 2-deoxyglucose-6-phosphate (2DG6P).

Cellular Symmetry Analysis

ImageJ was used to analyze cell morphological parameters. Perimeter was defined as the length of the outside boundary of a cell. Circularity was calculated as $4\pi \times area/perimeter^2$ wherein a value of 1.0 indicates a perfect circle. As the value approaches 0.0, the parameter indicates an increasingly elongated shape. Cell elongation was measured as aspect ratio:major axis/minor axis.

Exogenous TSP5 Transfer to Cells

Recombinant TSP5 (Sigma-Aldrich, SRP6457) was loaded into target cells using Pierce Protein Transfection Reagent Kit (Thermo Scientific, 89850). Reagent protein complexes attach to negatively charged cell surfaces, and either can directly fuse with the membrane to deliver the captured protein into the cell or undergo endocytosis and then fuse with the endosome, to release the captured protein into the cytoplasm. The Pierce™ Reagent was vortexed for 10 to 20 seconds at top speed before each use. For a 6-well plate or 33 mm dishes, 10 µL of reagent was pipetted. The solvent was evaporated by placing the microcentrifuge tubes containing the reagent under a laminar flow hood for 2 hours. The dried reagent was hydrated with the diluted solution of recombinant protein and carrier (TSP5, 100 ng+AlexaFluor-647-labelled ovalbumin, 5 µg) in 50 to 100 µL PBS. Then, the solution was mixed briefly by pipetting up and down 3 to 5 times, incubated at room temperature for 5 min and vortexed for 3 to 5 seconds at low to medium speed. Serum-free medium was added to the reagent/protein complex to bring the final delivery 15 volume up to 1 mL. The final delivery mix was transferred onto PBS-washed cells, incubated for 3 to 4 hours at 37° C., then one volume of 20% serum-containing medium was added directly to the well or dish to quench the reaction.

TSP5 Knockdown and Overexpression

All lentiviral particles were obtained from Sigma-Aldrich. To deplete TSP5, human primary pre-adipocytes (from subject ID: ABM-007) were transduced with pLKO.1-COMP shRNA (TRCN0000056075) and non-target control (SHC001V) lentiviral particles. To overexpress TSP5, human primary pre-adipocytes were transduced with pLX 317-COMP (TRCN0000470297) and control vector (ORFBFPV) lentiviral particles. Human primary pre-adipocytes were selected using growth media containing puromycin (0.5 µg/mL). To knockdown Tsp5 in 3T3-L1 mouse pre-adipocytes, mouse-specific pLKO.1-COMP shRNA (TRCN0000066166) and non-target control (SHCOO1V) lentiviral particles were used. Cells were selected using growth media containing puromycin (1 µg/mL). After selection in each case, the transduced pre-adipocytes were differentiated to mature adipocytes as described above.

Knockdown by siRNA Transfection

Cells were transfected with 25 nmol/L of listed siRNAs for 72 hours with Lipofectamine™ RNAiMAX Transfection Reagent (13778075, Thermo Fisher). Human Bromodomain and ExtraTerminal (BET) and non-targeting (scramble) SMARTpool siRNAs were purchased from Dharmacon. The pools in each case were comprised of five independent siRNAs. Catalog numbers are as follows: siBRD2 (L-004935-00-0005), siBRD3 (L-004936-00-0005) and siBRD4 (L-004937-00-0005).

Immunofluorescence (IF) Imaging

For IF imaging 100K cells were cultured in 27 mm glass bottom dishes (Thermo Fisher, 150682). For staining, cells were washed with DPBS including MgC12 and CaC12, then fixed with 4% paraformaldehyde (PFA) for 10 min. Then, cell membranes were permeabilized with Triton-X 100, 0.5% for 15 min. Cellular binding sites were blocked with bovine serum albumin (BSA), 2% (w:v) for 45 min. Then fixed, permeabilized and blocked cells were stained with primary antibodies (1:100 dilution, v:v) for 2 hours, washed 5 times, then stained with IF conjugated secondary antibodies (1:200 dilution, v:v) and phalloidin (1:1000 dilution, v:v) and DAPI counterstain. Finally, images were captured using a Nikon Deconvolution Wide-Field Epifluorescence System at the Boston University Cellular Imaging Core. Images were analyzed using ImageJ, with differences in means evaluated by comparison of a minimum of 25 individual, representative cells for each condition. Images were assembled in Adobe Photoshop Version 21.1.2. IF stain of proteins with primarily plasma membrane localization (such as E-cadherin) was quantified by selecting the plasma membrane and comparing across samples using the same method. Other proteins that have cytoplasmic or cell-wide distribution were quantified by selecting the whole cell. For TSPS exosome delivery experiments (FIG. 4), it was found that the extent of staining of AlexaFluor 647-ovalbumin carrier protein was not changed by the presence or absence of TSPS, from which it was concluded that TSPS does not alter the ability of exosomes to bind to or merge with the target cells Proteomics Analysis (Nanospray LC-MS/MS Analysis)

Exosome proteomics analysis was performed by Poochon Scientific LLC (Frederick, MD) using liquid chromatography with tandem mass spectrometry (LC-MS/MS). The protein of the exosome samples was denatured by 1% SDS and heated at 95° C., followed by digestion with trypsin (Pierce Trypsin Protease, MS grade; #90057). In brief, the denatured protein was reduced with dithiothreitol at 56° C. for 45 min, followed by alkylation with iodoacetamide for 30 min at room temperature in the dark. Alkylated proteins were then precipitated by 80% acetone, followed by trypsin digestion at 37° C. for 16 hours. The digested peptide mixture was then concentrated and desalted using C18 Zip-tip (ZTC18S960, Millipore). Reconstituted, desalted peptides were dissolved in 20 µL of 0.1% formic acid (Formic Acid Optima LC/MS (A11-50), Fisher Scientific) in LC-MS/MS grade water. Peptides (12 µL) were analyzed by 110 min LC-MS/MS run.

The LC-MS/MS analysis of samples was performed using an Orbitrap Exploris 240 Mass Spectrometer and a Dionex UltiMate 3000 RSLCnano System (both from Thermo Scientific). The Orbitrap Exploris 240 instrument was operated in the data dependent mode to automatically switch between full scan MS and MS/MS acquisition. Peptide mixture from each sample was loaded onto a peptide trap cartridge at a flow rate of 5 µL/min. The trapped peptides were eluted onto a reversed-phase EasySpray C18 column (Thermo) using a linear gradient of acetonitrile (3-36%) in 0.1% formic acid. The elution duration was 110 min at a flow rate of 0.3 µL/min. Eluted peptides from the EasySpray column were ionized and sprayed into the mass spectrometer, using a Nano-EasySpray Ion Source (Thermo) under the following settings: spray voltage, 1.6 kV, capillary temperature, 275° C. The 15 most intense multiply charged ions (z≥2) were sequentially isolated and fragmented in the octopole collision cell by higher-energy collisional dissociation (HCD) using normalized HCD collision energy 30 with an AGC target 1×105 and a maximum injection time of 200 ms at 17,500 resolution. The isolation window was set to 2. The dynamic exclusion was set to 20 s. Charge state screening was enabled to reject unassigned and 1+ and 7+ or higher charge state ions.

The raw data file acquired from each sample was searched against UniProtKB human protein sequences database (20, 547 entries, downloaded on Apr. 20, 2020) and target protein sequences were searched using the Proteome Discoverer 2.4 software (Thermo) based on the SEQUEST algorithm. Carbamidomethylation (+57.021 Da) of cysteines was fixed modification, and Oxidation Met and Deamidation Q/N-deamidated (+0.98402 Da) were set as dynamic modifications. The minimum peptide length was specified to be five amino acids. The precursor mass tolerance was set to 15 ppm, whereas fragment mass tolerance was set to 0.05 Da. The maximum false peptide discovery rate was specified as 0.01. The resulting Proteome Discoverer Report contains all assembled proteins with peptides sequences and peptide spectrum match counts (PSM #).

PCR Array

RNA was isolated from cells using RNeasy Plus Mini Kit (74136, Qiagen). From each sample, 1 µg of RNA was used to prepare 20 µL cDNA using QuantiTect Reverse Transcription Kit (Qiagen, 205313). Human RT2 Profiler™ PCR Array, including Epithelial to Mesenchymal Transition (EMT) (PAHS-090Z) and Cancer Stem Cell (PAHS-176ZC) arrays, were purchased from Qiagen. Each cDNA sample (102 µL comprised of 1 µg RNA) was mixed with 1,350 µL RT2 SYBR Green ROX qPCR Mastermix (Qiagen, 330522) and 1,248 µL RNAse-free water. A total volume of 2,700 µL was mixed by vortexing and transferred to a reservoir. Then, an 8 channel pipettor was used to take aliquots of reaction mix from the reservoir, to distribute 25 µL into each well of the array. PCR reactions were performed and results were analyzed using a 7500 Fast Real-Time PCR instrument.

Gene Expression Analysis

All Ct values of the genes were normalized to the respective ACTB gene (delta Ct). Then the ΔCt of each gene was subtracted from the control gene ΔCt (delta.delta Ct). For the control groups, delta.delta Ct was calculated using this formula: ΔΔCt=ΔCt (C1 or C2 or C3)—ΔCt (Control average). Then, fold-change was calculated using $2^{\wedge}-\Delta\Delta Ct$, (2 to the power of negative ΔΔCt). Next, the Z score was calculated based on this formula: Z score=(x-mean)/SD, where X is the fold-change. Hierarchical clustering analyses were performed using BioVinci Software (Bioturing, San Diego, CA, USA). Heatmaps were generated by applying clustering on rows (either: genes, pathways or diseases) using the Euclidean distance metrics and complete linkage criterion.

Ingenuity Pathway Analysis

To predict disease and function, and downstream pathways, data were analyzed through the use of Ingenuity Pathway Analysis, IPA (QIAGEN Inc.). Available on the world wide web at qiagenbioinformatics.com/products/ingenuity-pathway-analysis). Data were uploaded to an IPA account through software. Core analysis was conducted, then comparison analysis was performed on all the conditions of each experiment, including replicates. The p-value cutoff (log 10) was set to 1.3, which corresponds top-value of 0.05. The measurement activation Z-score range was −3.5 to +3.5. After running each IPA analysis, a representative heatmap of proteomics signatures was generated.

Flow Cytometry Analysis

Single cell suspensions were washed after collection and stained in ice-cold Ca+2/Mg+2.-free PBS with a viability dye (Zombie NIR, BioLegend) for 20 min at 4° C. in the dark. Cell suspensions were then washed twice with ice-cold flow cytometry buffer (Ca+2/Mg+2.-free PBS, supplemented with 2% FBS and 2 mM EDTA). Cell suspensions were then stained extracellularly with the appropriate antibodies for 25 min at 4° C., in the dark. CD324 (E-cadherin, clone 67A4) was conjugated to PerCP/Cy5.5 (BioLegend), CD44 (clone BJ18) was conjugated to APC (BioLegend) and CD24 (clone ML5) was conjugated to FITC (BD Biosciences). All cell suspensions were washed twice in ice-cold flow cytometry buffer prior to analysis. Unstained cells and single-stained controls were used to calculate flow cytometry compensation. Data acquisition (typically 1 million events) was performed on a BD LSRII instrument at the Boston University Flow Cytometry Core Facility. Data analysis was carried out using FlowJo Software (version 10.6.1, Tree Star).

Migration Assay

MDA-MB-231 cells were cultured in DMEM media (25 mM glucose+10% FBS+1% antibiotic supplementation) for 3 days with adipocyte-derived exosomes from non-diabetic patients (ND group), Type 2 Diabetic patients (T2D group) and fresh media (exosome control) or PBS (control) for three days. Cells were then switched to serum-free media for three hours and subsequently plated in 24-well, 8-micron pore size Transwell plates (Thermo Fisher) for 6 hours.

The cells were plated in the upper well of the transwell inserts with serum free media and the bottom well was filled with DMEM complete media to serve as a chemoattractant. Cells that stayed in the upper side of the membrane and did not migrate by the end of the assay were removed with a cotton swab, and the cells that migrated were fixed with ice-cold methanol for 5 minutes at −20° C. After fixation, cells were then stained with 1% crystal violet (v:v) in 2% ethanol for 10 minutes at room temperature. Images were captured by an EVOS XL Core digital inverted microscope. The percentage of migration and invasion was determined by first calculating the sum of the area of total migrated/invaded cells on the entire membrane with ImageJ software (National Institutes of Health, Bethesda, MD), and then converted to relative percent migration/invasion by comparing each condition to the control condition.

Kaplan-Meier Analysis

To investigate the correlation between distant metastasis-free survival (DMFS) and BRD2, BRD3, BRD4 and COMP expression, the inventors uilized data from 1803 (BRD2 and BRD3) and 664 (BRD4) patients from the TCGA repository (www.kmplot.com; list reference shown below). The normalized expression values of the RNAseq ID 214911 (BRD2), 212547 (BRD3), 226054 (BRD4) and 205713 (COMP) were used. For each gene, the mean expression was selected and cutoff values were determined by median expression. To assess the potential additive effects of the genes, samples with "low" BRD2, BRD3 or BRD4 expression and "low" COMP expression were combined into separate, individual cohorts and were compared to cohorts with "high" BRD2, BRD3 or BRD4 and "high" COMP expression. Kaplan-Meier plots were drawn by comparing the "low" and "high" cohorts to estimate the duration of survival. Hazard Ratios (HR) and p values are shown for distant metastasis-free survival (DMFS) (37).

Statistical Analysis

Statistical analyses for PCR experiments and in vitro cell culture assays were typically performed using unpaired, two-tailed Student's t-test. Biological and biochemical replicates were performed in at least triplicate and data are presented as means. Error bars represent standard error of measurement. Cellular morphology measurements were performed with at least 25 representative cells at the same magnification, in areas of equal culture density. The following symbols were used to indicate significant differences: ns $P>0.05$, * $P<0.05$,  $P<0.01$, * $P 20<0.005$, and **** $P<0.001$.

Biohazards

All the experiments executed for this study were conducted in accordance with NIH guidelines, under the oversight of the Boston University Institutional Biosafety Committee and with approval. Universal precautions were always observed for human primary tissue or cell lines.

REFERENCES

1. L. Vona-Davis, D. P. Rose, Type 2 diabetes and obesity metabolic interactions: common factors for breast cancer risk and novel approaches to prevention and therapy. Curr. Diabetes Rev. 8, 116-130 (2012).
2. D. F. Quail, A. J. Dannenberg, The obese adipose tissue microenvironment in cancer development and progression. Nat. Rev. Endocrinol. 15, 139-154 (2019).
3. J. R. Palmer, N. Castro-Webb, K. Bertrand, T. N. Bethea, G. V. Denis, Type II diabetes and incidence of estrogen receptor negative breast cancer in African American women. Cancer Res. 77, 6462-6469 (2017).
4. M. Charlot, N. Castro-Webb, T. N. Bethea, K. Bertrand, D. A. Boggs, G. V. Denis, L. L. Adams-Campbell, L. Rosenberg, J. R. Palmer, Diabetes and breast cancer mortality in Black women. Cancer Causes Control 28, 61-67 (2017).
5. G. Fantuzzi, Adipose tissue, adipokines, and inflammation. J. Allergy Clin. Immunol. 115, 911-919 (2005).
6. C. Chavey, B. Mari, M. N. Monthouel, S. Bonnafous, P. Anglard, E. Van Obberghen, S. Tartare-Deckert, Matrix metalloproteinases are differentially expressed in adipose tissue during obesity and modulate adipocyte differentiation. J. Biol. Chem. 278, 11888-11896 (2003).
7. Y. Y. Wang, C. Attane, D. Milhas, B. Dirat, S. Dauvillier, A. Guerard, J. Gilhodes, I. Lazar, et al, Mammary adipocytes stimulate breast cancer invasion through metabolic remodeling of tumor cells. JCI Insight 2, e87489 (2017).
8. J. Yang, R. A. Weinberg, Epithelial-mesenchymal transition: at the crossroads of development and tumor metastasis. Dev. Cell. 14, 818-829 (2008).
9. J. M. Stephens, J. Lee, P. F. Pilch, Tumor necrosis factor-alpha-induced insulin resistance in 3T3-L1 adipocytes is accompanied by a loss of insulin receptor substrate-1 and GLUT4 expression without a loss of insulin receptor-mediated signal transduction. J. Biol. Chem. 272, 971-976 (1997).
10. M. Quan, S. Kuang, Exosomal secretion of adipose tissue during various physiological states. Pharm. Res. 37, 221-234 (2020).
11. R. Kalluri, The biology and function of exosomes in cancer. J. Clin. Invest. 126, 1208-1215 (2016).
12. L. J. Vella, The emerging role of exosomes in epithelial-mesenchymal-transition in cancer. Front. Oncol. 4, 361 (2014).
13. N. M. Iyengar, A. Gucalp, A. J. Dannenberg, C. A. Hudis, Obesity and cancer mechanisms: Tumor microenvironment and inflammation. J. Clin. Oncol. 34, 4270-4276 (2016).
14. K. A. Brown, N. M. Iyengar, X. K. Zhou, A. Gucalp, K. Subbaramaiah, H. Wang, D. D. Gin, M. Morrow, et al, Menopause is a determinant of breast aromatase expression and its 27 associations with BMI, inflammation and systemic markers. J. Clin. Endocrinol. Metab. 102, 1692-1701 (2017).
15. N. M. Iyengar, X. K. Zhou, A. Gucalp, P. G. Morris, L. R. Howe, D. D. Gin, M. Morrow, H. Wang, et al, Systemic correlates of white adipose tissue inflammation in early-stage breast cancer, Clin. Cancer Res. 22, 2283-2289 (2016).
16. A. P. Morel, M. Lievre, C. Thomas, G. Hinkal, S. Ansieau, A. Puisieux, Generation of breast cancer stem cells through epithelial-mesenchymal transition. PLoS One 3, e2888 (2008).
17. I. M. Shapiro, A. W. Cheng, N. C. Flytzanis, M. Balsamo, J. S. Condeelis, M. H. Oktay, C. B. Burge, F. B. Gertler, An EMT-driven alternative splicing program occurs in human breast cancer and modulates cellular phenotype. PLoS Genet. 7, e1002218 (2011).

18. G. Andrieu, A. H. Tran, K. J. Strissel, G. V. Denis, BRD4 regulates breast cancer dissemination through Jagged1/Notch1 signaling. Cancer Res. 76, 6555-6567 (2016).
19. G. P. Andrieu, G. V. Denis, BET proteins exhibit transcriptional and functional opposition in the epithelial-to-mesenchymal transition. Mol. Cancer Res. 16, 580-586 (2018).
20. L. Lu, Z. Chen, X. Lin, et al, Inhibition of BRD4 suppresses the malignancy of breast cancer cells via regulation of Snail. Cell Death Differ 27, 255-268 (2020).
21. J. S. Shafran, G. P. Andrieu, B. Gyorffy, G. V. Denis, BRD4 regulates metastatic potential of castration-resistant prostate cancer through AHNAK. Mol. Cancer Res. 17, 1627-1638 (2019).
22. P. Kaur, G. M. Nagaraja, H. Zheng, D. Gizachew, M. Galukande, S. Krishnan, A. Asea, A mouse model for triple-negative breast cancer tumor-initiating cells (TNBC-TICs) exhibits similar aggressive phenotype to the human disease. BMC Cancer 12, 120 (2012).
23. B. A. Pulaski, S. Ostrand-Rosenberg, Mouse 4T1 breast tumor model. Curr. Protoc. Immunol. 20, 20.2.1-20.2.16 (2001).
24. F. Wang, H. Liu, W. P. Blanton, A. Belkina, N. K. Lebrasseur, G. V. Denis, Brd2 disruption in mice causes severe obesity without Type 2 diabetes. Biochem. J. 425, 71-83 (2009).
25. M. Zengerle, K. H. Chan, A. Ciulli, Selective small molecule induced degradation of the BET bromodomain protein BRD4. ACS Chem. Biol. 10, 1770-1777 (2015).
26. E. Englund, M. Bartoschek, B. Reitsma, L. Jacobsson, A. Escudero-Esparza, A. Orimo, et al., Cartilage oligomeric matrix protein contributes to the development and metastasis of breast cancer. Oncogene 35, 5585-5596 (2016).
27. K. S. Papadakos, M. Bartoschek, C. Rodriguez, C. Gialeli, S. B. Jin, U. Lendahl, et al., Cartilage Oligomeric Matrix Protein initiates cancer stem cells through activation of Jagged1-Notch3 signaling. Matrix Biol. 81, 107-121 (2019).
28. S. Liu, Y. Cong, D. Wang, et al. Breast cancer stem cells transition between epithelial and mesenchymal states reflective of their normal counterparts. Stem Cell Reports 2, 78-91 (2013).
29. A. C. Belkina, G. V. Denis, BET domain co-regulators in obesity, inflammation and cancer. Nat Rev Cancer 12, 465-477 (2012).
30. G. Andrieu, A. C. Belkina, G. V. Denis, Clinical trials for BET inhibitors run ahead of the science. Drug Discov. Today Technol. 19, 45-50 (2016).
31. E. E. Calle, R. Kaaks, Overweight, obesity and cancer: epidemiological evidence and proposed mechanisms. Nat Rev Cancer 4, 579-591 (2004).
32. J. L. Bosco, J. R. Palmer, D. A. Boggs, E. E. Hatch, L. Rosenberg, Cardiometabolic factors and breast cancer risk in U.S. black women. Breast Cancer Res Treat. 134, 1247-1256 (2012).
33. E. V. Bandera, U. Chandran, C. C. Hong, M. A. Troester, T. N. Bethea, L. L. Adams-Campbell, C. A. Haiman, S. Y. Park, A. F. Olshan, C. B. Ambrosone, J. R. Palmer, L. Rosenberg, Obesity, body fat distribution, and risk of breast cancer subtypes in African American women participating in the AMBER Consortium. Breast Cancer Res Treat. 150, 655-666 (2015).
34. M. N. Duong, A. Geneste, F. Fallone, X. Li, C. Dumontet, C. Muller, The fat and the bad: Mature adipocytes, key actors in tumor progression and resistance. Oncotarget 8, 57622-57641 (2017).
35. H. Xu, G. T. Barnes, Q. Yang, G. Tan, D. Yang, C. J. Chou, J. Sole, A. Nichols, J. S. Ross, L. A. Tartaglia, H. Chen, Chronic inflammation in fat plays a crucial role in the development of obesity-related insulin resistance. J Clin Invest. 112, 1821-1830 (2003).
36. J. P. Bastard, M. Maachi, C. Lagathu, M. J. Kim, M. Caron, H. Vidal, J. Capeau, B. Feve, Recent advances in the relationship between obesity, inflammation, and insulin resistance. Eur Cytokine Netw. 17, 4-12 (2006).
37. V. Christiaens, H. R. Lijnen, Angiogenesis and development of adipose tissue. Mol Cell Endocrinol. 318, 2-9 (2010).
38. S. Corvera, O. Gealekman, Adipose tissue angiogenesis: impact on obesity and type-2 diabetes. Biochim Biophys Acta. 1842, 463-72 (2014).
39. A. Engin, Adipose tissue hypoxia in obesity and its impact on preadipocytes and macrophages: Hypoxia hypothesis. Adv Exp Med Biol. 960, 305-326 (2017).
40. V. S. LeBleu, R. Kalluri, Exosomes as a multicomponent biomarker platform in cancer. Trends Cancer 6, 767-774 (2020).
41. M. J. Lee, S. K. Fried, Optimal protocol for the differentiation and metabolic analysis of human adipose stromal cells. Methods Enzymol. 538, 49-65 (2014).
42. B. Gyorffy, A. Lanczky, A. C. Eklund, C. Denkert, J. Budczies, Q. Li, Z. Szallasi, An online survival analysis tool to rapidly assess the effect of 22,277 genes on breast cancer prognosis using microarray data of 1809 patients. Breast Cancer Res Treatment 123, 725-731 (2010).

Example 3: Novel Plasma Exosome Biomarkers for Prostate Cancer Progression in Co-Morbid Metabolic Disease Comorbid Type-2 diabetes (T2D), a metabolic complication of obesity, associates with worse cancer outcomes for prostate, breast, head and neck, colorectal and several other solid tumors. However, the molecular mechanisms remain poorly understood. Exosomes as carriers of miRNAs in blood encode the metabolic status of the originating tissues and deliver their cargo to target tissues. The inventors hypothesized that T2D plasma exosomes induce epithelial-mesenchymal transition (EMT) and immune checkpoints in prostate cancer cells. It is shown herein that plasma exosomes from subjects with T2D induce EMT features in prostate cancer cells and upregulate the checkpoint genes CD274 and CD155. It is proven herein that specific exosomal miRNAs abundant in T2D plasma (miR374a-5p, miR-93-5p, miR-424-5p) are delivered to tumor cells and regulate these target genes. This builds on the data above showing BRD4 controls migration and dissemination of castration-resistant prostate cancer and transcription of key EMT genes, to show that T2D exosomes drive EMT and immune ligand expression through BRD4. The results indicate novel, non-invasive approaches to evaluate prostate cancer progression risk in patients with comorbid T2D.

Introduction

The incidence of obesity-driven diabetes continues to increase worldwide, and parallel to this trend, an increase in incidence of several obesity-related cancers has been reported [1]. Already in the U.S., for example, >100 million adults have been diagnosed with diabetes or pre-diabetes [2], about 90% as Type 2 diabetes (T2D) [3], a frequent metabolic complication of obesity, emphasizing the scale of the public health challenge. The severity of comorbid T2D also predicts worse cancer outcomes; associations are well established for breast cancer [4], head and neck cancer [5], colorectal cancer [6] and several other solid tumors. In prostate [7, 8] and other cancers [9], increased prevalence of comorbidity also correlates with advanced age [10] and worse outcomes. Yet the cellular and molecular mechanisms that explain these associations remain poorly understood. Comorbidity is insufficiently considered in clinical decision making. These knowledge gaps are important for medically underserved patient populations, where obesity and T2D are prevalent [11, 12], often in association with food deserts and an obesogenic built environment [13]. There is urgent need for novel, robust biomarkers to evaluate risks for cancer progression and assist clinical decision making for such underserved patients [14, 15].

New work in molecular endocrinology is revealing that cancer patients with comorbid chronic obesity and/or metabolic complications have adverse signaling in the adipose microenvironments of breast [16-19] or prostate tumors [20-22], compared to patients with the same type and stage of cancer, who are otherwise metabolically normal. In prostate cancer, obesity and its metabolic complications have been studied intensively to identify serological and histological data that would help identify cases at high risk for failure of androgen deprivation therapy (ADT), progression and metastasis in patients with these co-morbid conditions.

Metabolic biomarkers that include elevated insulin-like growth factor-1, insulin and C-peptide [23, 24], leptin, glucose [25, 26], pro-inflammatory cytokines, lipid profiles [27] and androgen levels have all been associated with worse outcomes [28, 29]. Metabolic status is also a concern because ADT is known to induce insulin resistance [30]. However, clinical trials have not yet established which serological markers of metabolism are most informative for the wide range of prostate cancer patients on various ADT and metabolic medications, and at which stages of disease progression specific markers would have greatest value. Innovative directions would be helpful.

The inventors took as a starting point the clinical observation that poor control of T2D in prostate cancer associates with rapid emergence of resistance to the anti-androgens abiraterone acetate and enzalutamide, compared to prostate cancer patients with well controlled blood glucose [26]. Noninvasive biomarkers have been explored for diagnostic, prognostic and therapeutic utility, including most recently circulating tumor DNA [31] and microRNAs (miRNA) [32]. In particular, miRNA biomarkers have gained attention because, unlike other nucleic acid biomarkers, these factors may be functional in prostate cancer [33]. Upon delivery to target tissues, miRNAs are capable of reprogramming cell metabolism and fate to affect the course of progression, metastasis and therapeutic responses. Deeper understanding of miRNA mechanism and gene targets may suggest novel therapeutics or prognostic biomarkers [34] to understand progression risks. The inventors investigated whether circulating miRNAs might differ between T2D and non-diabetic (ND) subjects.

Significant evidence implicates exosomes as carriers of miRNAs in blood [35], saliva [36] or other body fluids that can be sampled noninvasively for biomarker assessment in cancer. Several studies have investigated blood miRNAs derived from tumors as an approach to evaluate cancer diagnosis [37, 38], prognosis [39] and recurrence [40]. However, the inventors took a converse approach, and investigated plasma exosomal miRNAs as biomarkers of co-morbid T2D that instead might have functional impact on prostate cancer progression. The inventors' rationale is that obesity-driven metabolic disease has long been studied in prostate cancer incidence [41, 42], progression [43] and prostate cancer-specific mortality [44], although diabetes has been shown to be protective in some prostate cancer studies [45, 46]. Despite intensive investigation, the mechanisms and clinical variables most strongly associated with incidence, progression, distant metastasis and mortality [41, 47], and the impact of metabolic medications [48], have not been settled. The inventors considered that plasma exosomes in subjects with obesity-driven T2D might be leveraged to assess risk of progression and treatment resistance in prostate cancer, and might have functional significance to understand mechanisms of tumor progression.

As shown above herein, the metabolic status of mature adipocytes determines the payload of released exosomes. Adipocytes that have been rendered insulin resistant by exposure to pro-inflammatory cytokines, or that were isolated from adipose tissue of adult subjects with T2D, release exosomes that drive increased migration, invasiveness, epithelial-to-mesenchymal transition (EMT), gene expression associated with cancer stem-like cell formation and aggressive, pro-metastatic behavior in breast cancer cell models, compared to adipocytes that are insulin sensitive or isolated from adipose tissue of ND subjects [49]. The inventors built on these observations and hypothesized that similar phenotypes would be observed for plasma exosomes from T2D subjects compared to ND controls, using prostate cancer cell lines as a readout. It is described herein that exosomes from peripheral blood plasma of subjects with T2D induce EMT in DU145 cells, a model for hormone-refractory and aggressive prostate cancer.

Interestingly, exosomes purified from the plasma of ND subjects suppressed transcription of classical EMT genes in the same model, indicating that ND exosomes may harbor cancer chemopreventive miRNAs. In the same system it ws found that that T2D exosomes also induce expression of the immune checkpoint gene CD274, which encodes the immune checkpoint protein PD-L1. The somatic members of the Bromodomain and ExtraTerminal (BET) family of proteins (BRD2, BRD3, BRD4) are positive co-regulators of the PD-1/PD-L1 axis in triple negative breast cancer models [50]. BRD4 regulates migration and dissemination of castration-resistant prostate cancer and transcription of key EMT genes [51, 52]. Using the pan-BET inhibitor JQ1 and the BRD4-selective PROTAC degrader MZ-1, it is further demonstrated here that BRD4 is a critical effector for plasma exosome-driven prostate cancer aggressiveness, and functionally couples EMT and immune checkpoint gene expression in prostate cancer. These results establish a deeper, clinical translational investigation of plasma exosomes as functionally critical drivers of prostate tumor progression in patients with comorbid T2D, and as biomarkers that are both robust and non-invasive.

Materials and Methods

Cell Lines and Reagents

Cell lines were previously described [51, 52]. The DU145 prostate cancer cell line was cultured in RPMI-1640 medium (Gibco). All culture media were supplemented with 10% fetal bovine serum (FBS, Corning) and 1% antibiotics (penicillin/streptomycin, Gibco). As positive controls for induction of EMT genes or PD-L1, we treated the cells with transforming growth factor (TGF)-β or interferon (IFN)-γ (5 ng/mL), respectively, as previously published [53]. Paraformaldehyde solution (AAJ19943K2, Thermo Scientific) and 4',6-diamidino-2-phenylindole dihydrochloride (DAPI; FluoroPure grade; D21490, Thermo Scientific) were used to fix and stain the nuclei. Recombinant Human Interferon gamma protein (Active) (ab259377), and Recombinant human TGF beta 1 protein (ab50036) were purchased from Abcam.

RNA Staining and Immunofluorescence Imaging

Exosomal RNA was stained using SYTO™ RNASelect™ from Thermofisher (cat number: S32703) according to the manufacturer's protocol. Alexa Fluor™ 568 Phalloidin (Thermofisher, A12380) was used to stain the actin fibers. Cellular nuclei were stained by DAPI, FluoroPure™ grade (Thermofisher, D21490).

qRT-PCR

Procedures were as previously described [51, 52]. Briefly, total RNA was extracted from tumor cells using an RNAeasy Kit (Qiagen). Reverse transcription reactions were performed with 1 μg of total RNA with the QuantiTect Reverse Transcription kit (Qiagen). Gene expression was measured using TaqMan™ master mix (Thermofisher, 4369510) and human gene probes as follows: SNAI (Hs00195591_m1), SNA2 (Hs00950344_m1), CDH1 (Hs01023895_m1), ACTB (Hs00357333_g1), CD274 (encodes PD-L1, Hs01125301_m1), CD155 (encodes PVR or TIGIT ligand, Hs00197846_m1), VIM (Hs00958111_m1), TGFB1 (Hs00998133_m1), and AHNAK (Hs01102463_m1).

PCR Array

RNA was isolated using QuantiTect Reverse Transcription Kit (Qiagen), and 1 μg of each sample was used to prepare 20 μL cDNA using RNeasy Plus Mini Kit (Qiagen). Human RT$^2$ Profiler™ PCR Array, including Epithelial to Mesenchymal Transition (EMT) genes (PAHS-090Z), Cancer Stem Cell genes (PAHS-176ZC), and miRNA Array were purchased from Qiagen. Reverse transcription reactions were performed with RT$^2$ SYBR Green ROX qPCR Mastermix (Qiagen). Exosomal microRNAs were profiled using Human Serum/Plasma miRCURY LNA miRNA PCR array (Qiagen, #YAHS-106Y, Plate Format: 2×96-well).

Gene Expression Analysis

All Ct values of the genes were normalized to the respective ACTB gene (ΔCt). Then ΔCt of each gene was subtracted from the control gene ΔCt (Δ.ΔCt). For the control groups Δ.ΔCt was calculated using this formula: ΔΔCt=ΔCt (C1 or C2 or C3)−ΔCt (control average). Then, fold change was calculated using 2^−ΔΔCt, (2 to the power of negative ΔΔCt).

Next, the Z score was calculated based on this formula: Z score=(x-mean)/SD, in which X is the fold change. Bio Vinci software (San Diego, CA) was used to cluster the genes. In order to predict disease and function, data were analyzed through the use of Ingenuity Pathway Analysis, IPA (QIAGEN Inc., available on the world wide web at qiagenbioinformatics.com/products/ingenuity-pathway-analysis).

Exosome Isolation and Characterization

Patient whole blood was obtained commercially from Research Blood Components, LLC (Watertown, MA) on ice pack, centrifuged (16k rpm, 4° C., 30') to separate plasma, which was clarified again by centrifugation and filtration (0.2 μm) to remove large vesicles or apoptotic bodies. Exosomes were purified by size exclusion using qEV columns by automatic fractionation collector. The columns were packed with spherical beads (35 nm pore size) such that the spaces between the pores fractionate exosomes with size range of 35 nm-150 nm. The exosomes were eluted using PBS with 1 mM EDTA and stored at 4° C. for exosome size distribution and concentration measurements using a NanoSight NS300 system. Exosomal preparations underwent quality control analysis as previously published [49]. T2D and ND plasma origin exosomes were normalized to $10^9$ particles added per cell culture well.

MicroRNA Profiling of Plasma Exosomes

Exosomal RNA was isolated using exoRNeasy Midi Kit (Qiagen, 77144), For miRNA-specific first-strand cDNA synthesis, miRCURY LNA RT Kit (Qiagen, 339340) was used. Then, the PCR array analysis was conducted using miRCURY LNA SYBR Green PCR Kit (Qiagen, 339346) and Human Serum/Plasma miRCURY LNA miRNA PCR array (Qiagen, Catalog Number: YAHS-106Y, Plate Format: 2×96-Well) to detect plasma exosomes.

microRNA Delivery to DU145 Cells

Differentially expressed microRNAs in T2D exosomes were transfected using Lipofectamine RNAiMAX Transfection Reagent (13778150, Invitrogen). The human homologs of the synthesized microRNA mimics were purchased from Thermofisher. The miRBase Accession numbers are as follows: hsa-miR-374a-5p (MIMAT0000727), hsa-miR-93-5p (MIMAT0000093), and hsa-miR-424-5p (MIMAT0001341). After transfection, cells were incubated for 48 hr at 37° C., whereupon cellular total RNA was isolated and expression of SNAI1, PDL1, CDH1 and ACTB was analyzed in transfected cells.

Flow Cytometry Analysis

Single-cell suspensions were washed after collection and stained in ice-cold $Ca^{+2}/Mg^{+2}$-free PBS with a viability dye (Zombie NIR, BioLegend) for 20 min at 4° C. in the dark. Cell suspensions were then washed twice with ice-cold flow cytometry buffer ($Ca^{+2}/Mg^{+2}$-free PBS, supplemented with 2% FBS and 2 mM EDTA). Cell suspensions were then stained for PD-L1 (PE-conjugated, BD Biosciences). All cell suspensions were washed twice in ice cold flow cytometry buffer before analysis. Unstained cells and single-stained controls were used to calculate flow cytometry compensation. Data acquisition (typically 1 million events) was performed on a BD LSRII instrument at the Boston University Flow Cytometry Core Facility. Data analysis was carried out using FlowJo Software (version 10.6.1, Tree Star).

RNA Sequencing

Total RNA was isolated from DU145 cells that were untreated controls or were treated with exosomes isolated from the plasma of three ND subjects or three T2D subjects. Each experimental group was represented in biological triplicate. RNA sequencing workflow was conducted by Boston University School of Medicine Microarray and Sequencing Core. FASTQ files were aligned to human genome build hg38 using STAR [54], (version 2.6.0c). Ensembl-Gene-level counts for non-mitochondrial genes were generated using featureCounts (Subread package, version 1.6.2) and Ensembl annotation build 100 (uniquely aligned proper pairs, same strand). Separately, SAMtools (version 1.9) was used to count reads aligning in proper pairs at least once to either strand of the mitochondrial chromosome (chrM) or to the sense or antisense strands of Ensembl loci of gene biotype "rRNA" or of non-mitochondrial RepeatMasker loci of class "rRNA" (as defined in the RepeatMasker track retrieved from the UCSC Table Browser). FASTQ quality was assessed using FastQC (version 0.11.7), and alignment quality was assessed using RSeQC (version 3.0.0).

Variance-stabilizing transformation (VST) was accomplished using the "Variance Stabilizing Transformation" function in the DESeq2 R package (version 1.23.10) [55]. (Principal Component Analysis (PCA) was performed using the prcomp R function with variance stabilizing transformed (VST) expression values that were z-normalized (set to a mean of zero and a standard deviation of one) across all samples within each gene. Differential expression was assessed using the likelihood ratio test and Wald test implemented in the DESeq2 R package. Correction for multiple hypothesis testing was accomplished using the Benjamini-Hochberg false discovery rate (FDR). All analyses were performed using the R environment for statistical computing (version 4.0.2).

Statistical Analysis

To identify genes whose expression changes coordinately with respect to exosome treatment groups, a one-way analysis of variance (ANOVA) was performed using a likelihood ratio test to obtain a p value for each gene. Benjamini-Hochberg False Discovery Rate (FDR) correction was applied to obtain FDR-corrected p values (q values), which represent the probability that a given result is a false positive based on the overall distribution of p values. Corrected/adjusted p values such as the FDR q are the best measure of significance for a given test when many hypotheses (genes) are tested at once. The FDR q value was also recomputed after removing genes that did not pass the "independent filtering" step in the DESeq2 package. Genes with low overall expression are more strongly affected by random technical variation and more likely to produce false positive results. Wald tests were then performed for each gene between experimental groups to obtain a test statistic and p value for each gene. Statistical analyses of the in vitro experiments were performed using Student's t test or ANOVA as indicated, and were generated by GraphPad Prism software. $p<0.05$ was considered statistically significant.

Results

Exosomes from Plasma of T2D Subjects Induce EMT in Prostate Cancer Cell Lines

Figures 15A, 15B:
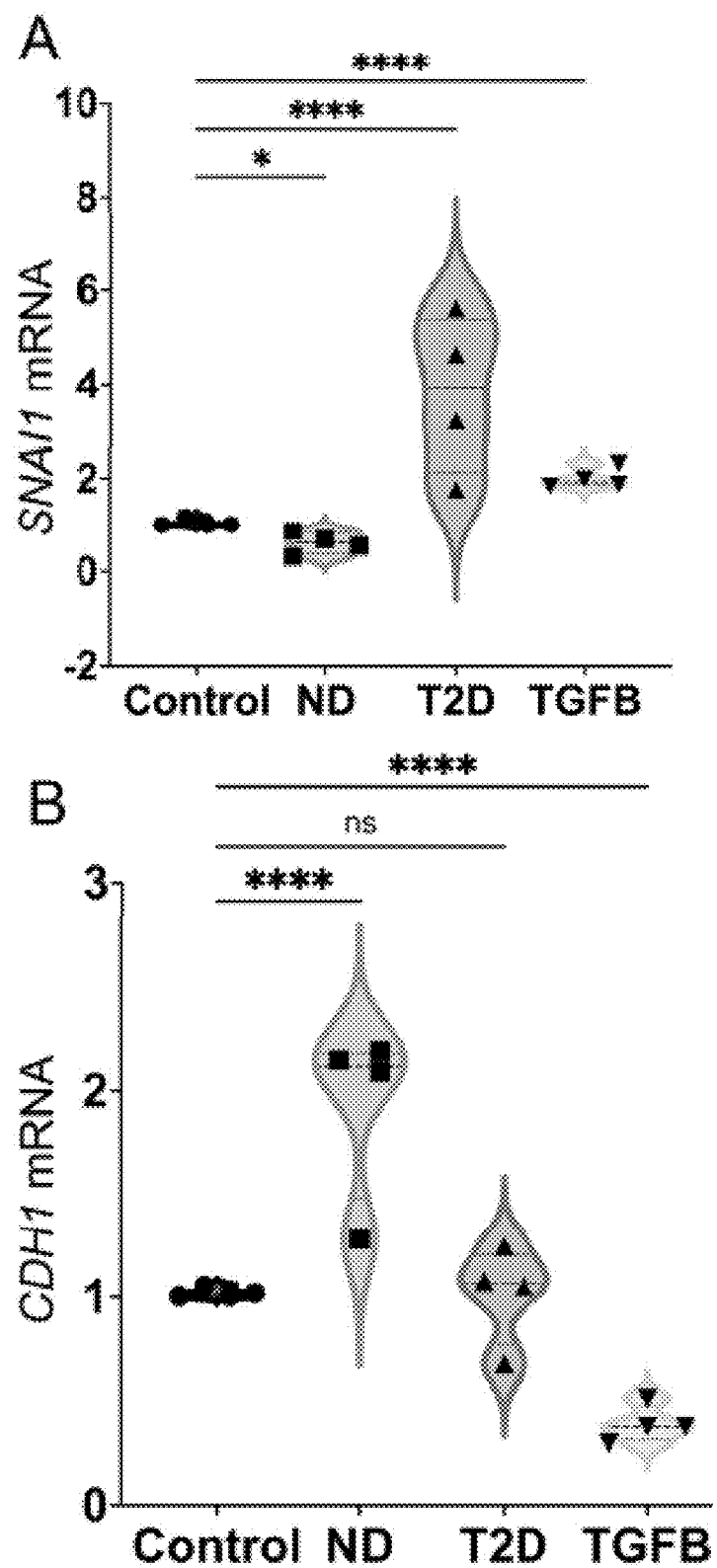
FIGS. 15A-15C demonstrate that human plasma exosomes from T2D subjects induce EMT genes in prostate cancer cell lines. The DU145 human prostate cancer cell line was treated with either ND or T2D plasma exosomes (109) for 2 days.
Figures 21A, 21B:
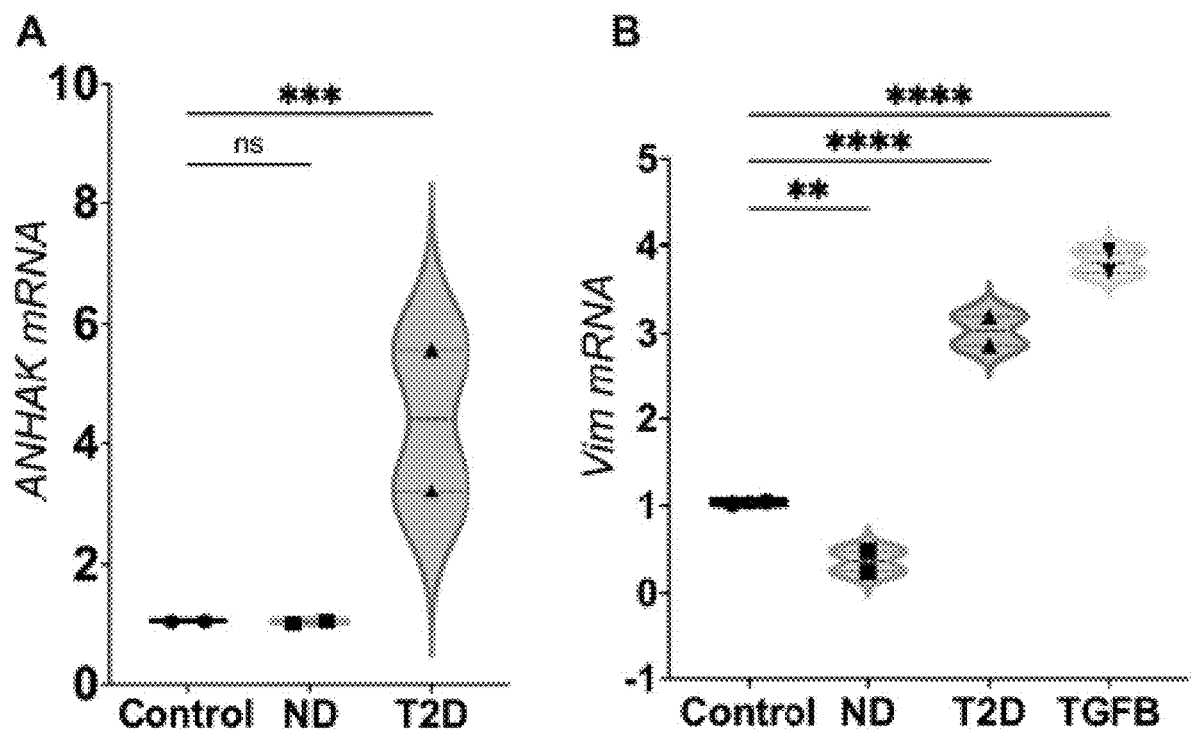
FIGS. 21A-21B depict T2D exosome induction of selected EMT genes, determined by RTPCR. Human plasma exosomes from T2D subjects (▲) induced representative EMT genes ANHAK (FIG. 21A) and VIMENTIN (Vim) (FIG. 21B) in DU145 cells, shown as fold-change relative to ACTB housekeeping gene (●). Responses for plasma exosomes from T2D subjects are compared to ND controls (■). Data were obtained from two biological replicates of ND and T2D; each biological replicate was conducted in three technical replicates. Data were analyzed by twoway ANOVA, with statistical significance presented as: , $p<0.01$; *, $p<0.001$; ****, $p<0.0001$; ns, not significant. ND, non-diabetic; T2D, Type 2 diabetic; TGFB, TGF-β positive control (▼).

Exosomes from conditioned media of mature adipocytes induce transcription of EMT genes in breast cancer cell lines. This induction is more pronounced if the adipocytes are insulin resistant or obtained from the adipose tissue of subjects with T2D [49]. First, it was tested whether plasma exosomes phenocopied this behavior, and induced EMT genes in prostate cancer cell lines. Exosomes were purified from EDTA-treated, anticoagulated peripheral blood plasma of three T2D subjects and treated DU145 cells with equal numbers of exosomes ($10^9$ in all cases) for two days, then isolated total RNA and assayed expression of the classical EMT genes vimentin (VIM), E-cadherin (CDH1), ANHAK and Snail (SNAI1) by RT-PCR with TaqMan probes. As hypothesized, T2D plasma exosomes induced EMT genes compared to equal numbers of exosomes purified from plasma of ND subjects or media (complete growth media containing RPMI-1640+10% FBS) control exosomes (FIG. 15A, FIGS. 21A-21B). Having thus validated the DU145 cell responses by RT-PCR, these same total RNAs were next analyzed on a commercial array for well-established EMT genes [49] and it was observed that the T2D plasma ex5osomes induced a coherent, pro-EMT signature in the DU145 cells compared to ND controls (FIG. 1C). Of the significantly differentially expressed genes in the commercial microarray, the T2D exosomes most strongly repressed CDH1, which encodes E-cadherin, as expected and as we have previously published for this gene associated with maintenance of the epithelial program and opposition to the mesenchymal program [49].

Figure 15C:
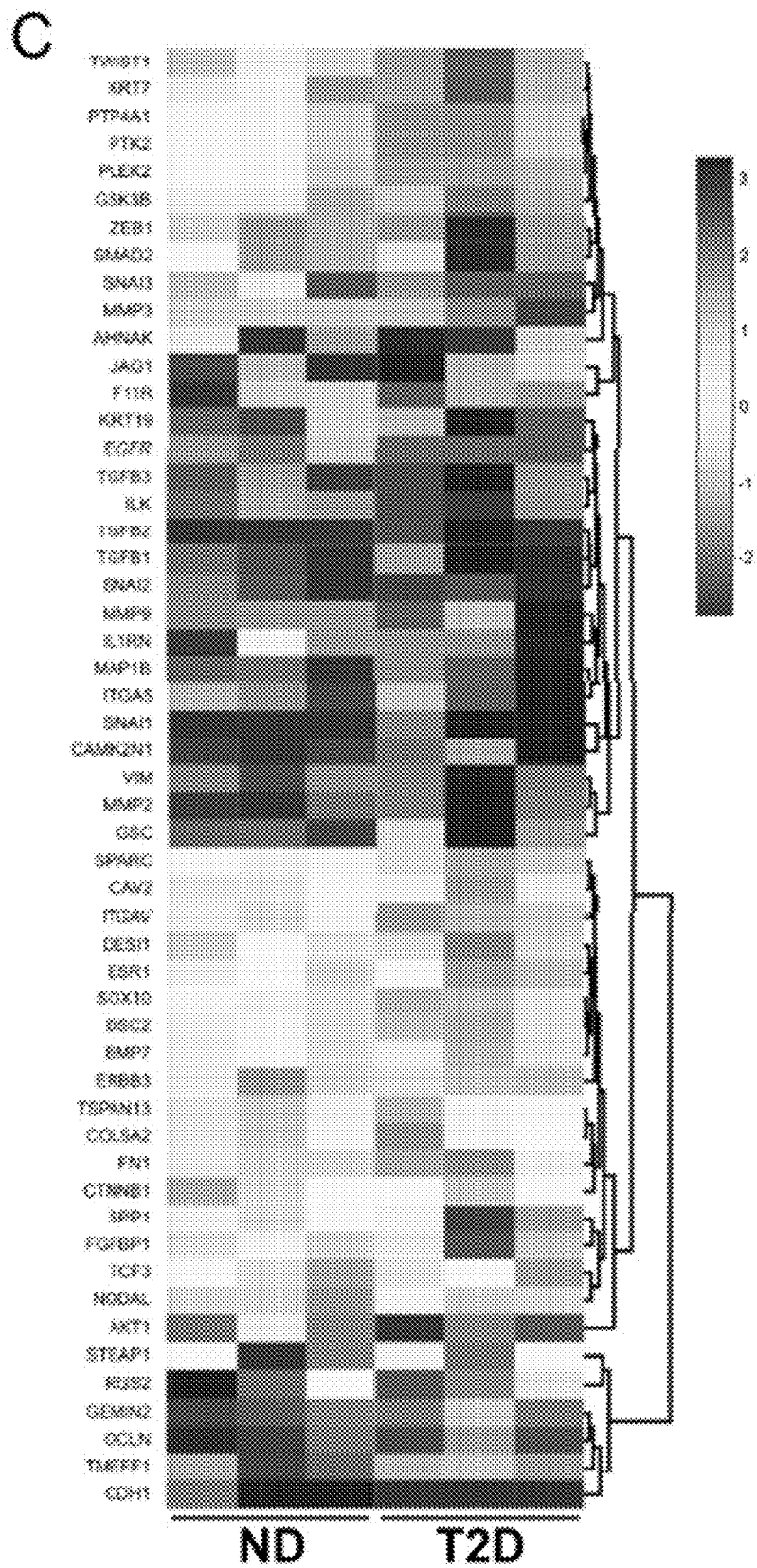
Figures 16A, 16B, 16C:
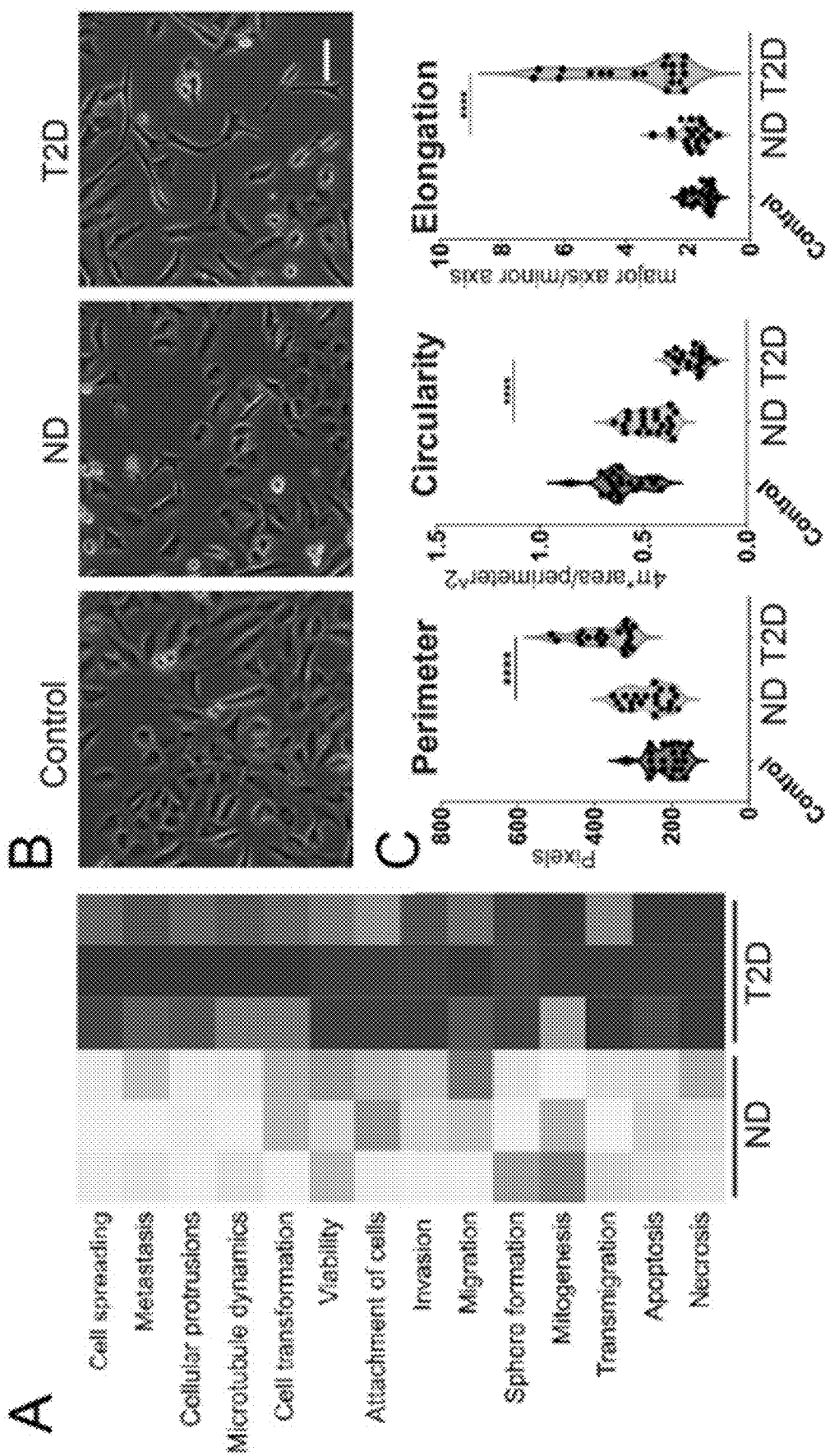
FIGS. 16A-16C demonstrate that plasma exosomes from T2D subjects induce major features of tumor cell aggressive behavior.

Ingenuity pathway analysis (IPA) of disease and function based on FIG. 15C revealed that plasma exosomes from T2D subjects strongly induced tumor cell aggressive features, such as cell spreading, protrusions, metastasis, cell motility and invasion compared to plasma exosomes from ND subjects (FIG. 16A), while pathways related to cell death by apoptosis or necrosis were downregulated by T2D exosomes, similar to what we have reported previously [49]. To confirm that T2D plasma exosomes also induce mesenchymal features (increased perimeter and elongation, and reduced circularity) as previously reported [49], morphological parameters were analyzed using ImageJ. DU145 cells treated with T2D plasma exosomes showed increased elongation and perimeter, and decreased circularity, compared to cells treated with ND plasma exosomes and control cells treated with media-only exosomes (FIGS. 16B-16C).

Exosomes from Plasma of T2D Subjects Induce PD-L1 Expression in DU145 Prostate Cancer Cells Gene signatures of EMT have been associated in several tumor types with immune infiltrates that express interferon-gamma (IFN-γ)-induced genes, and correspondingly with elevated expression of immune checkpoint proteins, such as PD-L1 [56-58]. The inventors explored whether, in addition to inducing EMT networks, T2D plasma exosomes also upregulate expression of immune checkpoint genes compared to ND plasma exosomes. It was found that plasma exosomes from T2D subjects did indeed upregulate genes that encode receptors important in cancer immunotherapy, including CD274 (FIG. 17A), which encodes PD-L1, and CD155 (FIG. 17B), which encodes the poliovirus receptor and is associated with resistance to immune checkpoint therapy in several cancer types.

Figures 17A, 17B, 17C:
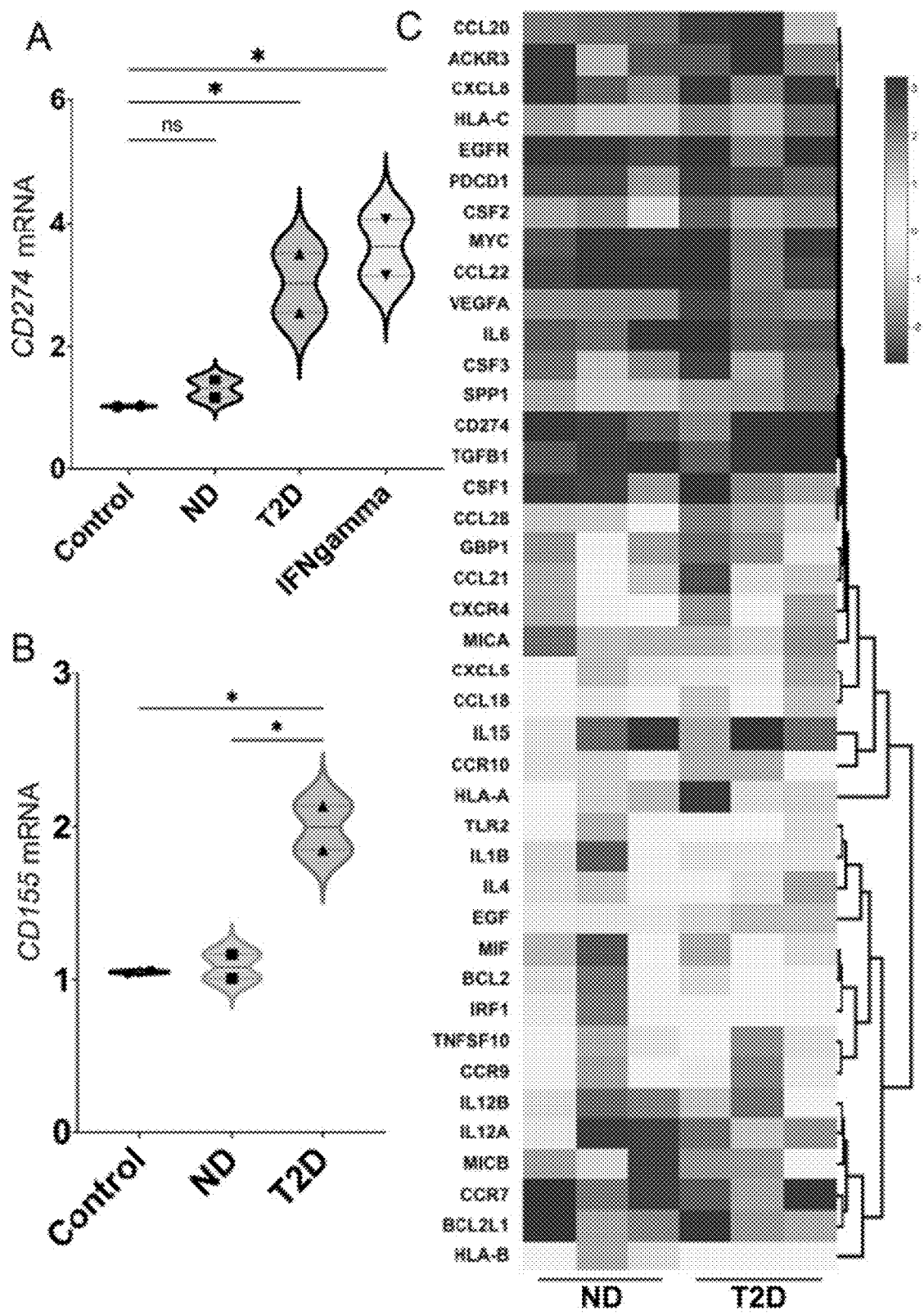
FIGS. 17A-17C demonstrate that T2D plasma exosomes upregulate genes that encode immune checkpoint ligands in prostate cancer cells. Plasma exosomes from T2D subjects (▲) upregulated CD274 (FIG. 17A) and CD155 (FIG. 17B) mRNA expression in DU145 cells after 2 days, compared to ND control (■). Treatment with IFN-γ (5 ng/mL) was the positive control for CD274 induction (▼), as previously published [53]. Treatment with growth media exosomes was the negative control (●). Data in FIGS. 17A and 17B were obtained from two biological replicates of ND and T2D, and each biological replicate was conducted in three technical replicates. Data were analyzed by two-way ANOVA with statistical significance presented as: *, $P<0.05$; ns, not significant.
Figure 22:
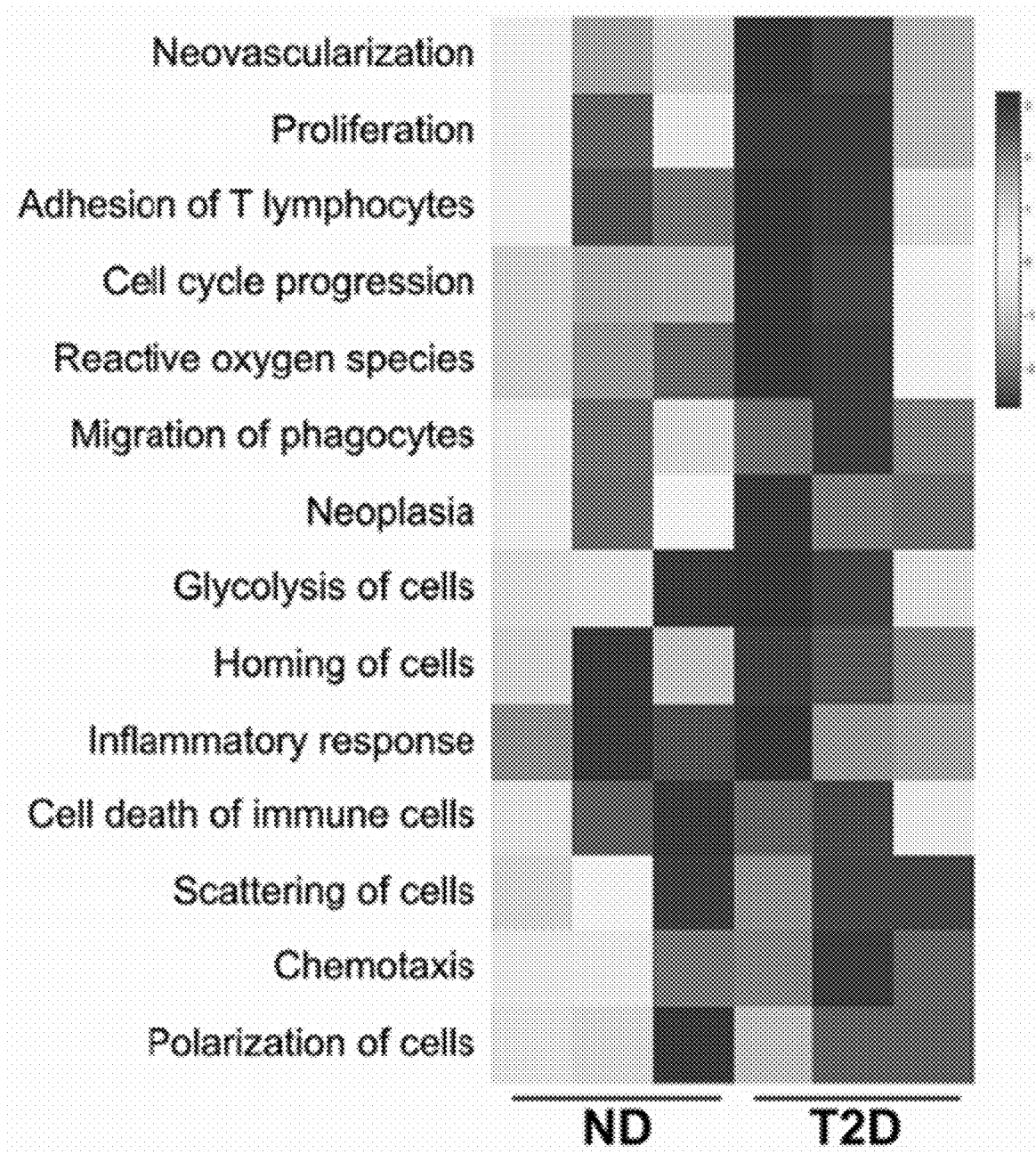
FIG. 22 depicts Ingenuity pathway analysis (IPA) of disease and function. IPA prediction based on FIG. 17C shows that plasma exosomes from T2D subjects induced major mechanisms associated with angiogenesis, immune dysfunction and tumor progression, compared to plasma exosomes from ND subjects. Three independent datasets for T2D are compared to three independent datasets for ND. Scale bar (right) shows fold change. (ND, non-diabetic; T2D, Type 2 diabetic)

Next, the effect of T2D exosomes on DU145 cells was analyzed, using a commercial array focused on genes involved in inflammation and cancer immune crosstalk. The T2D plasma exosomes induced a coherent, pro-inflammatory signature in DU145 cells compared to ND plasma exosomes (FIG. 17C). IPA analysis of the immune/inflammation microarray data from FIG. 17C showed that T2D plasma exosomes strongly upregulated major pathways associated with angiogenesis, immune dysfunction and tumor progression, compared to plasma exosomes from ND subjects (FIG. 22).

MicroRNA Profiling of Plasma Exosomes

Our previous studies on payload differences between exosomes released into conditioned media by mature adipocyte cultures from T2D vs ND subjects used mass spectrometry and proteomics to show that several proteins, particularly TSP5, were overrepresented in T2D exosomes [49]. Functional studies then showed that recombinant TSP5 alone was able to induce transcription of EMT gene signatures [49]. Therefore, a similar proteomics-based approach was used to investigate peptide differences between T2D and ND exosomes purified from human plasma. However, proteomics profiling of three ND and three T2D exosome isolates revealed no distinct pattern of peptides that were differentially represented between the groups (data not shown).

Figures 18A, 18B, 18C, 18D:
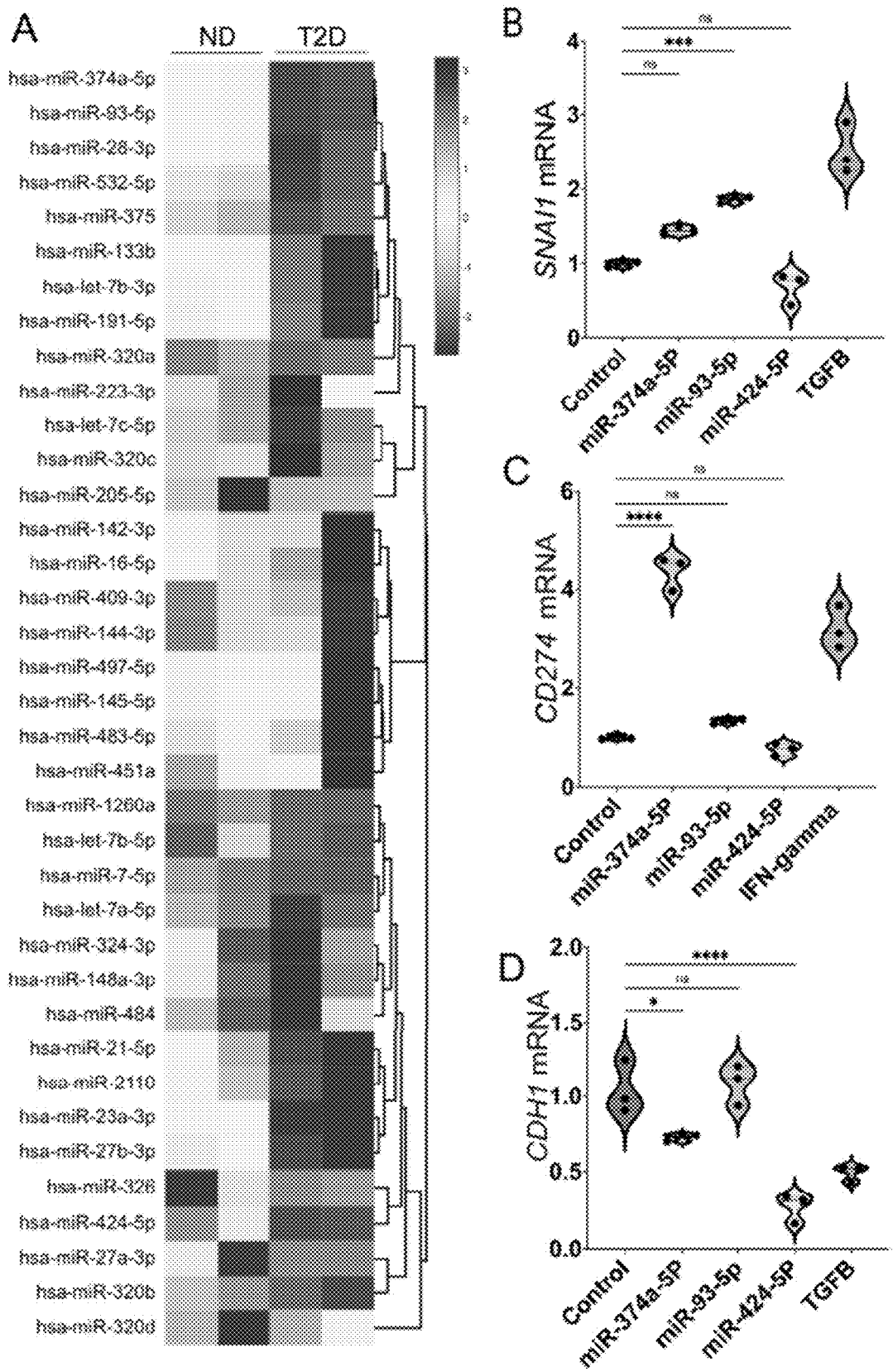
FIGS. 18A-18D demonstrate that T2D plasma exosomes have distinct microRNA profile compared to the ND plasma exosomes.

It was considered that miRNAs might be differentially expressed instead of proteins, and might encode functional activities that drive the observed EMT and immune checkpoint gene expression. MicroRNA profiles of plasma exosomes from T2D and ND subjects were compared by a human serum/plasma miRNA PCR array and it was found that the metabolic differences associate with a different miRNA signature. The five miRNAs that clustered as the most increased in T2D plasma exosomes compared to ND plasma exosomes were: miR-374a-5p, miR-93-5p, miR-28-3p, miR532-5p and miR375 (FIG. 18A). Other miRNAs showed reduced differential expression in T2D plasma exosomes compared to ND plasma exosomes. The five miRNAs that clustered as the most decreased were: miR-326, miR424-5p, miR-27a-3p, miR320b and miR320d (FIG. 18A).

Three of FIG. 18A's were obtained miRNAs from commercial sources and DU145 cells were treated with 25 nM of each, for 2 days. Then total cellular RNA was isolated, cellular cDNA synthesized and fold-changes of SNAI1 CD274 and CDH1 were compared to ACTB as measured by RT-PCR with TaqMan probes (FIGS. 18C-18D). It was found that miR374a-5p upregulated CD274 (FIG. 18C) but not SNAI1 (FIG. 18B) and slightly downregulated CDH1 (FIG. 18D); miR-93-5p upregulated SNAI1 (FIG. 18B) but not CD274 (FIG. 18C) and did not affect CDH1 (FIG. 18D); and miR-424-5p downregulated CDH1 (FIG. 18D) but had no effect on SNAI1 (FIG. 18B) or CD274 (FIG. 18C). These results supported the overall hypothesis that T2D exosomal miRNAs are functionally active in tumor cell line models, when assayed as individual recombinant miRNAs.

Figures 23A, 23B:
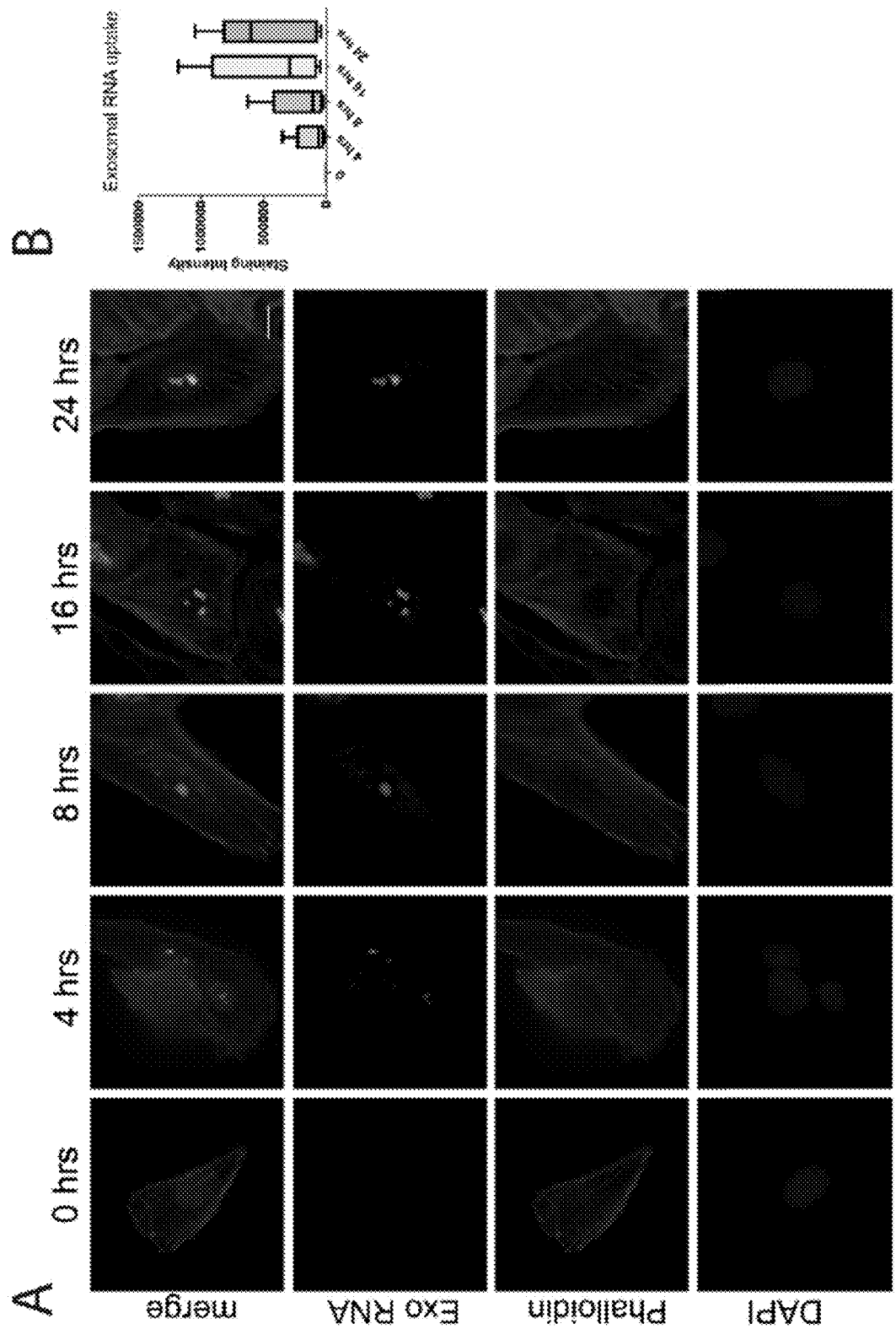
FIGS. 23A-23B depict the time course of exosomal RNA uptake into DU145 cell nuclei.

A control experiment was also performed to prove that exosomal RNAs are taken up by DU145 cells. Exosome RNA was stained with RNA selective dye, then the stained exosomes were added to DU145 cells and visualized by fluorescence microscopy over several hours to track localization. Time course analysis showed that after 16 and 24 hours, the plasma exosomes RNA became concentrated in the nuclei (FIGS. 23A-23B). Uptake reached a plateau by 16 hours.

RNA Sequencing and Principal Component Analysis (PCA)

Figures 24A, 24B, 24C:
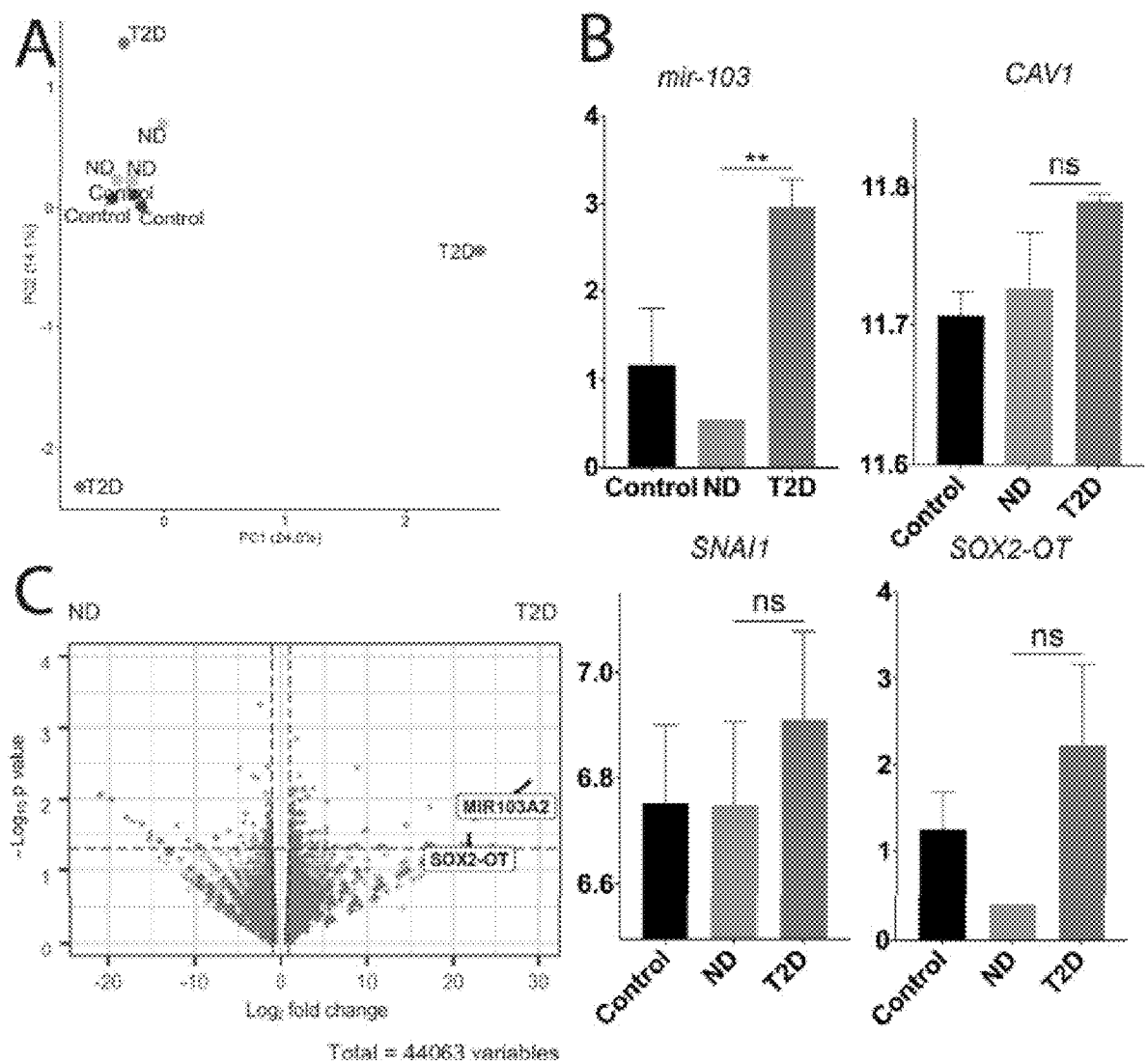
FIGS. 24A-24C depict genome-wide transcriptional analysis by RNA seq.

Next, the global transcriptional changes in prostate cancer cell lines caused by T2D exosomes in comparison to the ND exosomes was investigated. RNA sequencing and Principal Component Analysis of all signals showed that total RNA transcripts from DU145 cells treated with exosomes isolated from plasma of ND subjects had similar global transcription patterns. The transcripts from cells treated with media-only control exosomes and ND plasma exosomes clustered together well. However, transcripts from DU145 cells treated with exosomes from T2D subjects were widely separated and unique. T2D samples 1 and 2 clearly separate from the other samples along PC1 (24% of variance) and PC2 (14% of variance), respectively, indicating that there is significant biological variability with respect to treatment with the T2D exosomes (FIG. 24A). The interpretation of this result is that ND plasma exosomes did not induce significant variation in genome-wide patterns of RNA expression compared to negative controls, but the expression induced by different T2D patient exosomes differ widely from ND controls, each in their own way. Furthermore, when T2D plasma exosomes are compared to ND, a group of genes upregulated specifically by miR-103 (FIG. 24B) was identified immune exhaustion.

IPA analysis of differential expression of all the genes in the datasets was undertaken. Network analysis revealed that miR103a and SOX2-OT induce EMT and PD-L1 expression. MiR-103a and SOX2-OT were upregulated 28.8 and 21.8 times in DU145 cells treated with T2D exosomes compared to ND exosomes (Table 2, FIG. 24C). Interestingly, these two genes were downregulated (5 and 3.6-fold, respectively) in the ND exosome group compared to the media-only exosome control group (Table 2). The RNA seq datasets were further analyzed by IPA and the potential connections of dysregulated genes and cancer cell EMT and immune exhaustion through BET proteins were explored. IPA analysis revealed that miR103a and SOX2-OT induce Cav1 and VIM respectively, which ultimately promote EMT and PD-L1 expression through BRD4 (FIG. 5). Additionally, RNA seq data showed that SNAI1 and CAV1 had an upregulated trend although it was not significant (FIG. 24B).

Figure 19A:
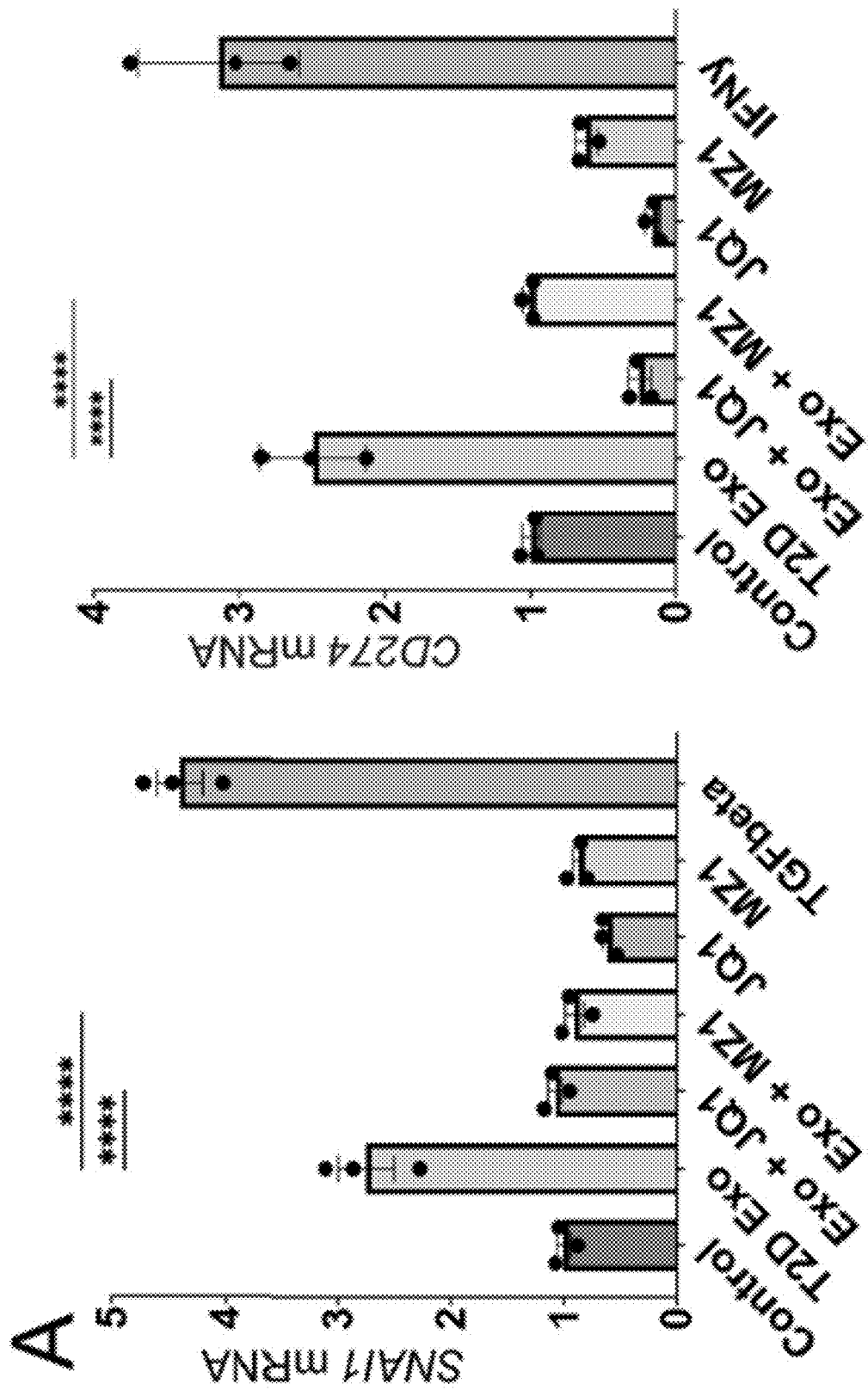
FIGS. 19A-19C demonstrate that T2D plasma exosomes require BRD4 to upregulate EMT genes and PD-L1 expression.
Figure 19B:
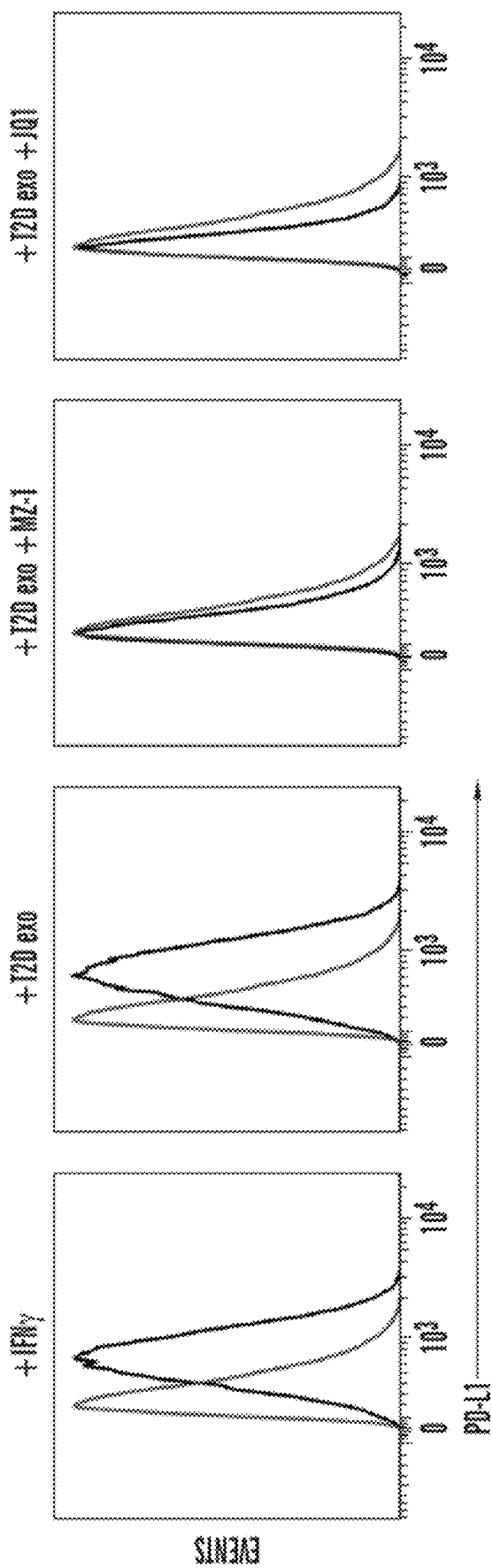
Figure 19C:
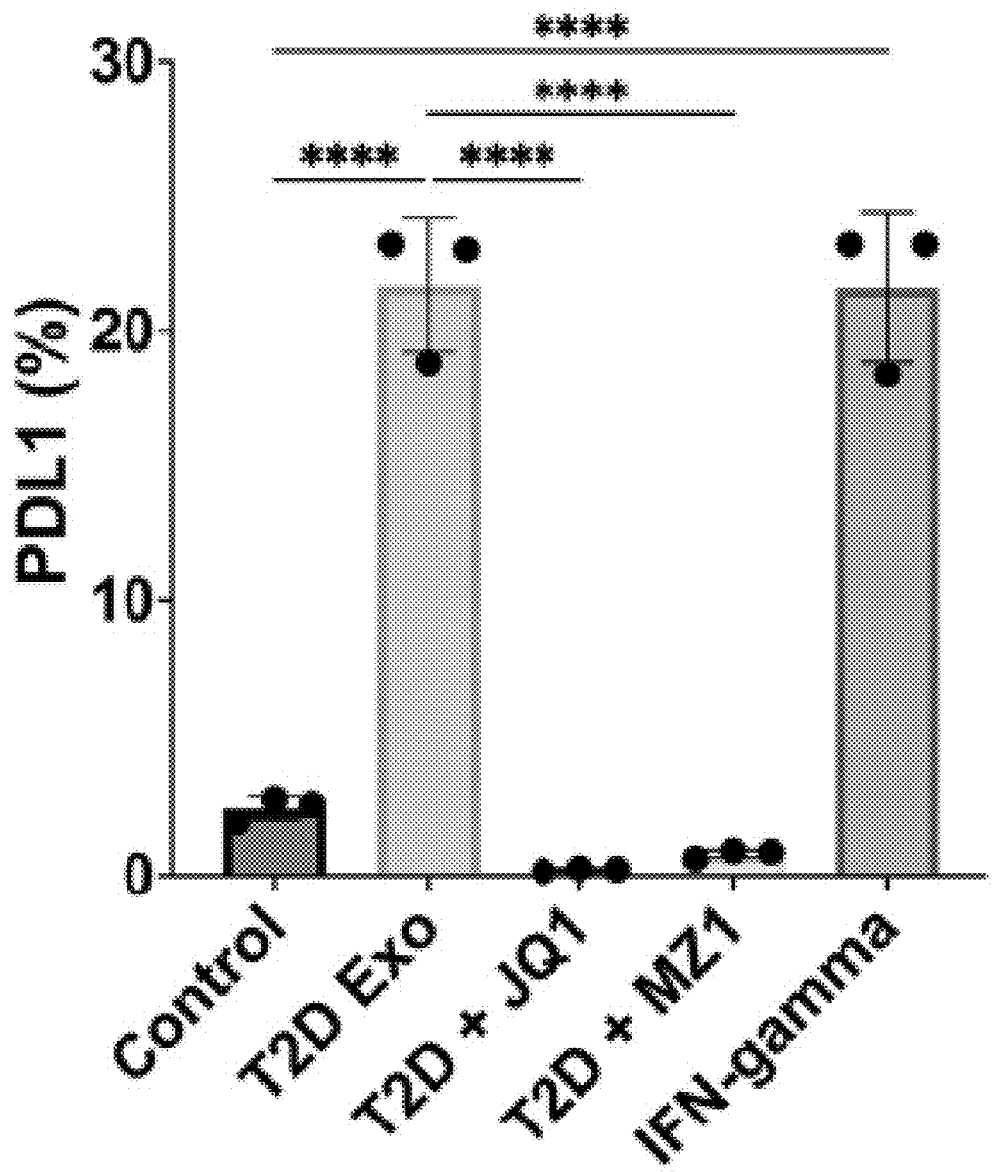

The somatic BET bromodomain proteins BRD2, BRD3 and BRD4 play critical roles in transcriptional control of classical EMT genes [53, 65, 66], as well as control of immune checkpoint genes, such as PDCD1 and CD274, which encode PD-1 and PD-L1, respectively. These findings have since been confirmed by others [67-69]. It was therefore hypothesized here that the BET protein family functions as a central node in exosome-driven signal transduction, linking EMT to immune checkpoint function, and demonstrated here in prostate cancer cells. In DU145 cells low concentrations of the BRD4-selective PROTAC degrader MZ-1 (50 nM) are indeed selective to eliminate BRD4 protein while preserving BRD2 and BRD3, whereas high doses (400 nM) eliminate all three somatic BET proteins [51]. The small molecule JQ1 inhibits BET bromodomain activity through a different mechanism by competitively binding to the histone binding pocket of the bromodomain, and is not highly selective among BRD2, BRD3 and BRD4, thus it was used as a positive control for inhibition of all BET proteins, not just BRD4. The transcription of SNAI1 and CD274 genes was measured by RT-PCR. It was found that MZ-1 at BRD4-selective concentrations in DU145 cells inhibited expression of SNAI1 induced by T2D plasma exosomes, and the pan-BET inhibitor JQ1 was not able to reduce expression below the BRD4-selective level (FIG. 19A). Interestingly, MZ-1 had the same inhibitory effect on CD274, but JQ1 was able to inhibit transcription to below baseline (FIG. 19A). It was then verified by flow cytometry that PD-L1 protein expressed on the surface of treated DU145 cells was induced by T2D exosome treatment, and inhibited by MZ-1 or JQ1 (FIG. 19B).

Discussion

Prostate cancer exhibits significant genomic and histologic heterogeneity that complicates prognostic assessment and clinical decision making. Disease can be indolent and localized, oligoclonal with non-overlapping mutational profiles among nearby clones [70], or aggressive with rapid progression and metastatic dissemination of a lethal clone [71]. A large subgroup of cases appears to be indolent at the early stage; it is important to resolve the indolent cases from aggressive cases that demand immediate treatment. Although serum level of Prostate Specific Antigen (PSA) has proven utility in combination with digital rectal examination for diagnostic screening [72, 73], PSA accuracy is suboptimal to understand cancer risks [74, 75].

Described herein is a new approach of exploring plasma exosomes for functional biomarkers for, e.g., prostate cancer patients. This report is the first to describe how plasma exosomes from subjects with Type 2 diabetes (i) drive pro-EMT transcriptional shifts and (ii) elevate immune checkpoint expression in human prostate cancer models. Surprisingly, it was also found that plasma exosomes from ND controls showed activity to downregulate certain classical, pro-EMT genes, such as SNAI1 and to upregulate certain classical anti-EMT genes, such as CDH1, in prostate cancer cell lines (FIG. 15C). This observation indicates that ND status can encode chemopreventive factors that are packaged into plasma exosomes that circulate and protect against prostate cancer progression.

The initial approach to use differential proteomics analysis of the exosomes to identify peptides with significantly different abundance between T2D and ND exosomes recapitulated the previous approach, where proteomics analysis of exosomes purified from conditioned media of insulin-resistant vs insulin-sensitive mature adipocytes was used [49]. The inventors turned now instead to analysis of miRNAs to identify potential differences. Here, it was found that commercial array kits were adequate to reveal interesting miRNA profiles.

To investigate this model, the RNA seq data of DU145 cells treated with plasma exosomes from T2D and ND subjects were compared. We found that the T2D exosomes upregulated a subset of genes that play critical roles in both EMT and immune exhaustion (Table 2). In order to illustrate the pathway, genes and their fold change values were imported to IPA. By using the path explorer feature of the software, the connections among upregulated genes, EMT genes and immune exhaustion genes were revealed (FIG. 19A). IPA output revealed that miR103 and SOX-2-OT stimulate CAV1 and VIM respectively. Downstream in the pathway, BRD4 acts as the critical node, and activates SNAI1 and CD274, which subsequently drive EMT and immune checkpoint expression. In addition to miR-103, SOX-2-OT was significantly upregulated in DU145 cells treated with T2D plasma exosomes.

Figure 20:
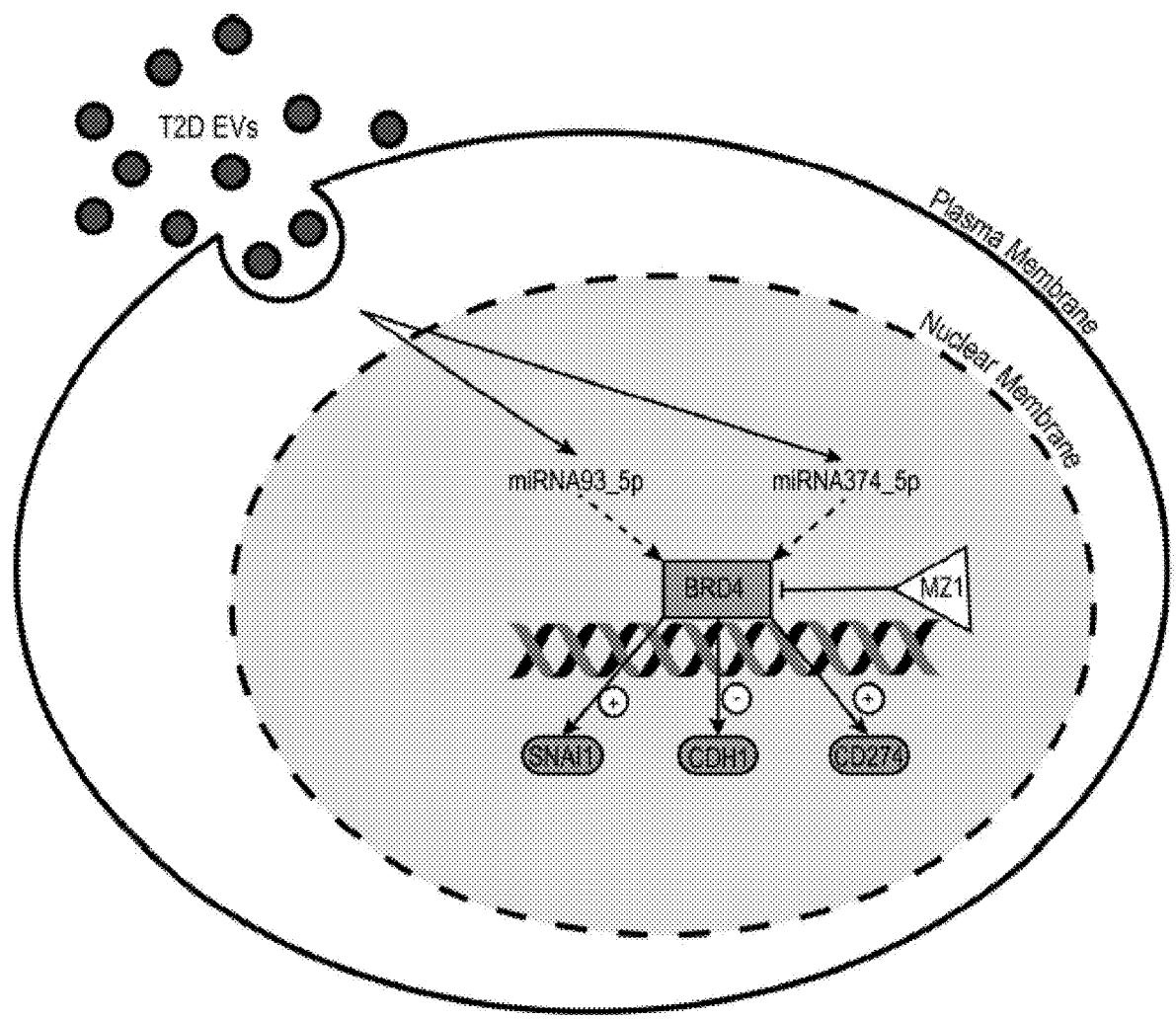
FIG. 20 depicts a model for T2D exosome delivery of miRNAs that reprogram transcription of tumor cell genes important for cancer aggressiveness. Circulating exosomes in plasma arrive at the tumor cell surface where they are internalized and release their cargo of miRNAs. These miRNAs are trafficked to the nucleus where they reprogram signal transduction pathways. In this case, miR-93-5p and miR374a-5p are shown signaling through BRD4, which is an essential transcriptional co-regulator of genes important for tumor cell aggressiveness, SNAI1, CDH1 and CD274.

Taken together, these data indicate a new signaling map to link the pro-EMT effect of T2D plasma exosomes with PD-L1 expression through BRD4 (FIG. 20). PD-L1 targeting is a major treatment strategy for several current cancer clinical trials of checkpoint inhibitors. The PDL1 findings have clinical relevance related to utility of checkpoint inhibitors for treatment of advanced prostate cancer. Although checkpoint inhibitors have demonstrated significant efficacy in other advanced malignancies, the outcomes in advanced prostate cancer have been disappointing. Randomized phase III studies have failed to demonstrate an overall survival benefit in advanced prostate cancer [81, 82]. These studies, as well as several smaller studies with PD-1/PD-L1 inhibitors, did demonstrate clinical benefit in a small percentage of patients, yet there is ongoing need to identify markers to predict response or resistance. As we show here, Type 2 diabetes works through plasma exosome crosstalk to increase the plasticity of prostate cancer primary cells, and induce immune exhaustion markers important for microenvironment interactions with tumor-infiltrating T cells.

In conclusion, the present findings show that T2D plasma exosomes induce prominent EMT and immune checkpoint markers in DU145 cells. This study is the first report to unravel the oncogenic function of T2D plasma exosomes that drives metastatic progression and treatment failure in castration-resistant prostate cancer.

REFERENCES

[1] C. Steele, C. Thomas, Henley S J, Massetti G M, Galuska D A, Agurs-Collins T, Puckett M, Richardson L C, Vital signs: trends in incidence of cancers associated with overweight and obesity-United States, 2014 (2005) 1052-1058.

[2] Centers for Disease Control and Prevention, National diabetes statistics report, 2020, Atlanta, GA: Centers for Disease Control and Prevention, US Department of Health and Human Services, (2020) 12-15.

[3] S. Yaturu, Obesity and type 2 diabetes, Journal of diabetes mellitus, 1 (2011) 79-95.

[4] S. T. Fleming, A. Rastogi, A. Dmitrienko, K. D. Johnson, A comprehensive prognostic index to predict survival based on multiple comorbidities: a focus on breast cancer, Medical care, (1999) 601-614.

[5] K. d. C. B. Ribeiro, L. P. Kowalski, M. d. R. D. De Oliveira, Perioperative complications, comorbidities, and survival in oral or oropharyngeal cancer, Archives of Otolaryngology—Head & Neck Surgery, 129 (2003) 219-228.

[6] R. Rieker, E. Hammer, R. Eisele, E. Schmid, J. Högel, The impact of comorbidity on the overall survival and the cause of death in patients after colorectal cancer resection, Langenbeck's Archives of Surgery, 387 (2002) 72-76.

[7] C. Kastner, J. Armitage, A. Kimble, J. Rawal, P. Carter, S. Venn, The Charlson comorbidity score: a superior comorbidity assessment tool for the prostate cancer multidisciplinary meeting, Prostate cancer and prostatic diseases, 9 (2006) 270-274.

[8] A. Berglund, H. Garmo, C. Tishelman, L. Holmberg, P. Stattin, M. Lambe, Comorbidity, treatment and mortality: a population based cohort study of prostate cancer in PCBaSe Sweden, The Journal of urology, 185 (2011) 833-840.

[9] M. Extermann, Interaction between comorbidity and cancer, Cancer Control, 14 (2007) 13-22.

[10] J. Coebergh, M. Janssen-Heijnen, P. Post, P. Razenberg, Serious co-morbidity among unselected cancer patients newly diagnosed in the southeastern part of The Netherlands in 1993-1996, Journal of clinical epidemiology, 52 (1999) 1131-1136.

[11] K.-L. C. Jen, K. Brogan, O. G. Washington, J. M. Flack, N. T. Artinian, Poor nutrient intake and high obese rate in an urban African American population with hypertension, Journal of the American College of Nutrition, 26 (2007) 57-65.

[12] R. B. Cadzow, T. J. Servoss, C. H. Fox, The health status of patients of a student-run free medical clinic in inner-city Buffalo, NY, The Journal of the American Board of Family Medicine, 20 (2007) 572-580.

[13] G. A. Nichols, M. McBurnie, L. Paul, J. E. Potter, S. McCann, K. Mayer, G. Melgar, S. D'Amato, J. E. DeVoe, Peer Reviewed: The High Prevalence of Diabetes in a Large Cohort of Patients Drawn From Safety Net Clinics, Preventing chronic disease, 13 (2016).

[14] H. K. Seligman, E. A. Jacobs, A. Lopez, U. Sarkar, J. Tschann, A. Fernandez, Food insecurity and hypoglycemia among safety net patients with diabetes, Archives of Internal Medicine, 171 (2011) 1204-1206.

[15] S. A. Berkowitz, X. Gao, K. L. Tucker, Food-insecure dietary patterns are associated with poor longitudinal glycemic control in diabetes: results from the Boston Puerto Rican Health study, Diabetes care, 37 (2014) 2587-2592.

[16] N. J. Vickers, Animal communication: when I'm calling you, will you answer too?, Current biology, 27 (2017) R713-R715.

[17] C. Muller, Tumour-surrounding adipocytes are active players in breast cancer progression, Annales d'endocrinologie, Elsevier, 2013, pp. 108-110.

[18] L. Lore, H. An, L. Evelyne, V. B. Mieke, V. Jo, M. Dawn, B. Geert, V. D. B. Rudy, M. Catherine, B. Marc, Secretome analysis of breast cancer-associated adipose tissue to identify paracrine regulators of breast cancer growth, Oncotarget, 8 (2017) 47239.

[19] C. Vaysse, J. Lømo, Ø. Garred, F. Fjeldheim, T. Lofteroed, E. Schlichting, A. McTiernan, H. Frydenberg, A. Husøy, S. Lundgren, Inflammation of mammary adipose tissue occurs in overweight and obese patients exhibiting early-stage breast cancer, NPJ breast cancer, 3 (2017) 1-10.

[20] V. Laurent, A. Guérard, C. Mazerolles, S. Le Gonidec, A. Toulet, L. Nieto, F. Zaidi, B. Majed, D. Garandeau, Y.

Socrier, Periprostatic adipocytes act as a driving force for prostate cancer progression in obesity, Nature communications, 7 (2016) 1-15.

[21] V. Laurent, A. Toulet, C. Attané, D. Milhas, S. Dauvillier, F. Zaidi, E. Clement, M. Cinato, S. Le Gonidec, A. Guérard, Periprostatic adipose tissue favors prostate cancer cell invasion in an obesity-dependent manner: role of oxidative stress, Molecular Cancer Research, 17 (2019) 821-835.

[22] D. Estève, M. Roumiguié, C. Manceau, D. Milhas, C. Muller, Periprostatic adipose tissue: A heavy player in prostate cancer progression, Current Opinion in Endocrine and Metabolic Research, 10 (2020) 29-35.

[23] J. Hammarsten, B. Högstedt, Hyperinsulinaemia: a prospective risk factor for lethal clinical prostate cancer, European journal of cancer, 41 (2005) 2887-2895.

[24] J. Ma, H. Li, E. Giovannucci, L. Mucci, W. Qiu, P. L. Nguyen, J. M. Gaziano, M. Pollak, M. J. Stampfer, Prediagnostic body-mass index, plasma C-peptide concentration, and prostate cancer-specific mortality in men with prostate cancer: a long-term survival analysis, The lancet oncology, 9 (2008) 1039-1047.

[25] J. L. Wright, S. R. Plymate, M. P. Porter, J. L. Gore, D. W. Lin, E. Hu, S. B. Zeliadt, Hyperglycemia and prostate cancer recurrence in men treated for localized prostate cancer, Prostate cancer and prostatic diseases, 16 (2013) 204-208.

[26] T. Karantanos, S. Karanika, G. Gignac, Uncontrolled diabetes predicts poor response to novel antiandrogens, Endocrine-related cancer, 23 (2016) 691-698.

[27] L. Magura, R. Blanchard, B. Hope, J. R. Beal, G. G. Schwartz, A. E. Sahmoun, Hypercholesterolemia and prostate cancer: a hospital-based case—control study, Cancer Causes & Control, 19 (2008) 1259-1266.

[28] E. Kheterpal, J. D. Sammon, M. Diaz, A. Bhandari, Q.-D. Trinh, N. Pokala, P. Sharma, M. Menon, P. K. Agarwal, Effect of metabolic syndrome on pathologic features of prostate cancer, Urologic Oncology: Seminars and Original Investigations, Elsevier, 2013, pp. 1054-1059.

[29] J. Flanagan, P. K. Gray, N. Hahn, J. Hayes, L. Myers, C. Carney-Doebbeling, C. Sweeney, Presence of the metabolic syndrome is associated with shorter time to castration-resistant prostate cancer, Annals of Oncology, 22 (2011) 801-807.

[30] I.-C. Yu, H.-Y. Lin, J. D. Sparks, S. Yeh, C. Chang, Androgen receptor roles in insulin resistance and obesity in males: the linkage of androgen-deprivation therapy to metabolic syndrome, Diabetes, 63 (2014) 3180-3188.

[31] A. W. Wyatt, M. Annala, R. Aggarwal, K. Beja, F. Feng, J. Youngren, A. Foye, P. Lloyd, M. Nykter, T. M. Beer, Concordance of circulating tumor DNA and matched metastatic tissue biopsy in prostate cancer, JNCI: Journal of the National Cancer Institute, 109 (2017).

[32] R. Kanwal, A. R. Plaga, X. Liu, G. C. Shukla, S. Gupta, MicroRNAs in prostate cancer: Functional role as biomarkers, Cancer Letters, 407 (2017) 9-20.

[33] A. M. Aghdam, A. Amiri, R. Salarinia, A. Masoudifar, F. Ghasemi, H. Mirzaei, MicroRNAs as diagnostic, prognostic, and therapeutic biomarkers in prostate cancer, Critical Reviews™ in Eukaryotic Gene Expression, 29 (2019).

[34] A. Watahiki, R. J. Macfarlane, M. E. Gleave, F. Crea, Y. Wang, C. D. Helgason, K. N. Chi, Plasma miRNAs as biomarkers to identify patients with castration-resistant metastatic prostate cancer, International journal of molecular sciences, 14 (2013) 7757-7770.

[35] G. Rabinowits, C. Gercel-Taylor, J. M. Day, D. D. Taylor, G. H. Kloecker, Exosomal microRNA: a diagnostic marker for lung cancer, Clinical lung cancer, 10 (2009) 42-46.

[36] A. Michael, S. D. Bajracharya, P. S. Yuen, H. Zhou, R. A. Star, G. G. Illei, I. Alevizos, Exosomes from human saliva as a source of microRNA biomarkers, Oral diseases, 16 (2010) 34-38.

[37] J. Skog, T. Würdinger, S. van Rijn, D. Meijer, L. Gainche, Glioblastoma microvesicles transport RNA and proteins that promote tumour growth and provide diagnostic biomarkers. Nat Cell Biol10 (12): 1470-6. [10.1038/ncb1800] Chapter 1 of tumor-derived exosomes as diagnostic biomarkers of ovarian cancer, Gynecol Oncol, 110 (2008) 13-21.

[38] R. Nedaeinia, M. Manian, M. Jazayeri, M. Ranjbar, R. Salehi, M. Sharifi, F. Mohaghegh, M. Goli, S. Jahednia, A. Avan, Circulating exosomes and exosomal microRNAs as biomarkers in gastrointestinal cancer, Cancer gene therapy, 24 (2017) 48-56.

[39] N. Kosaka, H. Iguchi, T. Ochiya, Circulating microRNA in body fluid: a new potential biomarker for cancer diagnosis and prognosis, Cancer science, 101 (2010) 2087-2092.

[40] T. Matsumura, K. Sugimachi, H. Iinuma, Y. Takahashi, J. Kurashige, G. Sawada, M. Ueda, R. Uchi, H. Ueo, Y. Takano, Exosomal microRNA in serum is a novel biomarker of recurrence in human colorectal cancer, British journal of cancer, 113 (2015) 275-281.

[41] S. J. Freedland, W. J. Aronson, Examining the relationship between obesity and prostate cancer, Reviews in Urology, 6 (2004) 73.

[42] K. Di Sebastiano, J. Pinthus, W. Duivenvoorden, M. Mourtzakis, Glucose impairments and insulin resistance in prostate cancer: The role of obesity, nutrition and exercise, Obesity Reviews, 19 (2018) 1008-1016.

[43] F. Nik-Ahd, L. E. Howard, A. T. Eisenberg, W. J. Aronson, M. K. Terris, M. R. Cooperberg, C. L. Amling, C. J. Kane, S. J. Freedland, Poorly controlled diabetes increases the risk of metastases and castration-resistant prostate cancer in men undergoing radical prostatectomy: Results from the SEARCH database, Cancer, 125 (2019) 2861-2867.

[44] S. Kelkar, T. Oyekunle, A. Eisenberg, L. Howard, W. J. Aronson, C. J. Kane, C. L. Amling, M. R. Cooperberg, Z. Klaassen, M. K. Terris, Diabetes and Prostate Cancer Outcomes in Obese and Nonobese Men After Radical Prostatectomy, JNCI Cancer Spectrum, 5 (2021) pkab023.

[45] M. F. Sona, S.-K. Myung, K. Park, G. Jargalsaikhan, Type 1 diabetes mellitus and risk of cancer: a meta-analysis of observational studies, Japanese journal of clinical oncology, 48 (2018) 426-433.

[46] R. Peila, T. E. Rohan, Diabetes, glycated hemoglobin, and risk of cancer in the UK biobank study, Cancer Epidemiology and Prevention Biomarkers, 29 (2020) 1107-1119.

[47] A. J. Burton, K. M. Tilling, J. M. Holly, F. C. Hamdy, M.-A. E. Rowlands, J. L. Donovan, R. M. Martin, Metabolic imbalance and prostate cancer progression, International journal of molecular epidemiology and genetics, 1 (2010) 248.

[48] A. J. Klil-Drori, L. Azoulay, M. N. Pollak, Cancer, obesity, diabetes, and antidiabetic drugs: is the fog clearing?, Nature reviews Clinical oncology, 14 (2017) 85-99.

[49] N. Jafari, M. Kolla, T. Meshulam, J. S. Shafran, Y. Qiu, A. N. Casey, I. R. Pompa, C. S. Ennis, C. S. Mazzeo, N. Rabhi, S. R. Farmer, G. V. Denis, Adipocyte-derived exosomes may promote breast cancer progression in type 2 diabetes, Science Signaling, 14 (2021) eabj2807.

[50] B. Zhang, Y. Yang, X. Shi, W. Liao, M. Chen, A. S.-L. Cheng, H. Yan, C. Fang, S. Zhang, G. Xu, Proton pump inhibitor pantoprazole abrogates adriamycin-resistant gastric cancer cell invasiveness via suppression of Akt/GSK-β/β-catenin signaling and epithelial-mesenchymal transition, Cancer letters, 356 (2015) 704-712.

[51] J. S. Shafran, G. P. Andrieu, B. Györffy, G. V. Denis, BRD4 regulates metastatic potential of castration-resistant prostate cancer through AHNAK, Molecular Cancer Research, 17 (2019) 1627-1638.

[52] J. S. Shafran, N. Jafari, A. N. Casey, B. Györffy, G. V. Denis, BRD4 regulates key transcription factors that drive epithelial-mesenchymal transition in castration-resistant prostate cancer, Prostate cancer and prostatic diseases, 24 (2021) 268-277.

[53] G. P. Andrieu, J. S. Shafran, C. L. Smith, A. C. Belkina, A. N. Casey, N. Jafari, G. V. Denis, BET protein targeting suppresses the PD-1/PD-L1 pathway in triple-negative breast cancer and elicits anti-tumor immune response, Cancer letters, 465 (2019) 45-58.

[54] A. Dobin, C. A. Davis, F. Schlesinger, J. Drenkow, C. Zaleski, S. Jha, P. Batut, M. Chaisson, T. R. Gingeras, STAR: ultrafast universal RNA-seq aligner, Bioinformatics, 29 (2013) 15-21.

[55] M. I. Love, W. Huber, S. Anders, Moderated estimation of fold change and dispersion for RNA-seq data with DESeq2, Genome biology, 15 (2014) 1-21.

[56] Y. Lou, L. Diao, E. R. P. Cuentas, W. L. Denning, L. Chen, Y. H. Fan, L. A. Byers, J. Wang, V. A. Papadimitrakopoulou, C. Behrens, Epithelial-mesenchymal transition is associated with a distinct tumor microenvironment including elevation of inflammatory signals and multiple immune checkpoints in lung adenocarcinoma, Clinical Cancer Research, 22 (2016) 3630-3642.

[57] J. C. Thompson, W.-T. Hwang, C. Davis, C. Deshpande, S. Jeffries, Y. Rajpurohit, V. Krishna, D. Smirnov, R. Verona, M. V. Lorenzi, Gene signatures of tumor inflammation and epithelial-to-mesenchymal transition (EMT) predict responses to immune checkpoint blockade in lung cancer with high accuracy, Lung Cancer, 139 (2020) 1-8.

[58] M. Taki, K. Abiko, M. Ukita, R. Murakami, K. Yamanoi, K. Yamaguchi, J. Hamanishi, T. Baba, N. Matsumura, M. Mandai, Tumor Immune Microenvironment during Epithelial-Mesenchymal Transition, Clinical Cancer Research, 27 (2021) 4669-4679.

[59] Q. Lin, C.-R. Zhou, M.-J. Bai, D. Zhu, J.-W. Chen, H.-F. Wang, M.-A. Li, C. Wu, Z.-R. Li, M.-S. Huang, Exosome-mediated miRNA delivery promotes liver cancer EMT and metastasis, American journal of translational research, 12 (2020) 1080.

[60] D. Son, Y. Kim, S. Lim, H.-G. Kang, D.-H. Kim, J. W. Park, W. Cheong, H. K. Kong, W. Han, W.-Y. Park, miR-374a-5p promotes tumor progression by targeting ARRB1 in triple negative breast cancer, Cancer letters, 454 (2019) 224-233.

[61] L. Liang, L. Zhao, Y. Zan, Q. Zhu, J. Ren, X. Zhao, MiR-93-5p enhances growth and angiogenesis capacity of HUVECs by down-regulating EPLIN, Oncotarget, 8 (2017) 107033.

[62] Y. Yang, B. Jia, X. Zhao, Y. Wang, W. Ye, miR-93-5p may be an important oncogene in prostate cancer by bioinformatics analysis, Journal of cellular biochemistry, 120 (2019) 10463-10483.

[63] X. Liang, Z. Li, Q. Men, Y. Li, H. Li, T. Chong, miR-326 functions as a tumor suppressor in human prostatic carcinoma by targeting Mucin1, Biomedicine & Pharmacotherapy, 108 (2018) 574-583.

[64] K. Kang, J. Zhang, X. Zhang, Z. Chen, MicroRNA-326 inhibits melanoma progression by targeting KRAS and suppressing the AKT and ERK signalling pathways, Oncology reports, 39 (2018) 401-410.

[65] G. Andrieu, A. H. Tran, K. J. Strissel, G. V. Denis, BRD4 regulates breast cancer dissemination through Jagged1/Notch1 signaling, Cancer research, 76 (2016) 6555-6567.

[66] G. P. Andrieu, G. V. Denis, BET proteins exhibit transcriptional and functional opposition in the epithelial-to-mesenchymal transition, Molecular Cancer Research, 16 (2018) 580-586.

[67] S. J. Hogg, S. J. Vervoort, S. Deswal, C. J. Ott, J. Li, L. A. Cluse, P. A. Beavis, P. K. Darcy, B. P. Martin, A. Spencer, BET-bromodomain inhibitors engage the host immune system and regulate expression of the immune checkpoint ligand PD-L1, Cell reports, 18 (2017) 2162-2174.

[68] X. Wang, Y. Zhou, Y. Peng, T. Huang, F. Xia, T. Yang, Q. Duan, W. Zhang, Bromodomain-containing protein 4 contributes to renal fibrosis through the induction of epithelial-mesenchymal transition, Experimental cell research, 383 (2019) 111507.

[69] X. Jing, S. Shao, Y. Zhang, A. Luo, L. Zhao, L. Zhang, S. Gu, X. Zhao, BRD4 inhibition suppresses PD-L1 expression in triple-negative breast cancer, Experimental cell research, 392 (2020) 112034.

[70] M. C. Haffner, W. Zwart, M. P. Roudier, L. D. True, W. G. Nelson, J. I. Epstein, A. M. De Marzo, P. S. Nelson, S. Yegnasubramanian, Genomic and phenotypic heterogeneity in prostate cancer, Nature Reviews Urology, 18 (2021) 79-92.

[71] O. Sartor, J. S. de Bono, Metastatic prostate cancer, New England Journal of Medicine, 378 (2018) 645-657.

[72] W. J. Catalona, D. S. Smith, T. L. Ratliff, K. M. Dodds, D. E. Coplen, J. J. Yuan, J. A. Petros, G. L. Andriole, Measurement of prostate-specific antigen in serum as a screening test for prostate cancer, New England Journal of Medicine, 324 (1991) 1156-1161.

[73] R. Etzioni, A. Tsodikov, A. Mariotto, A. Szabo, S. Falcon, J. Wegelin, D. Ditommaso, K. Karnofski, R. Gulati, D. F. Penson, Quantifying the role of PSA screening in the US prostate cancer mortality decline, Cancer Causes & Control, 19 (2008) 175-181.

[74] B. Djavan, A. Zlotta, M. Remzi, K. Ghawidel, A. Basharkhah, C. C. SCHULMAN, M. MARBERGER, Optimal predictors of prostate cancer on repeat prostate biopsy: a prospective study of 1,051 men, The Journal of urology, 163 (2000) 1144-1149.

[75] I. M. Thompson, D. K. Pauler, P. J. Goodman, C. M. Tangen, M. S. Lucia, H. L. Parnes, L. M. Minasian, L. G. Ford, S. M. Lippman, E. D. Crawford, Prevalence of prostate cancer among men with a prostate-specific antigen level≤4.0 ng per milliliter, New England Journal of Medicine, 350 (2004) 2239-2246.

[76] H. Y. Chen, Y. M. Lin, H. C. Chung, Y. D. Lang, C. J. Lin, J. Huang, W. C. Wang, F. M. Lin, Z. Chen, H. D. Huang, miR-103/107 promote metastasis of colorectal cancer by targeting the metastasis suppressors DAPK and KLF4, Cancer research, 72 (2012) 3631-3641.

[77] D. Gao, B. Hou, D. Zhou, Q. Liu, K. Zhang, X. Lu, J. Zhang, H. Zheng, J. Dai, Tumorderived exosomal miR-103a-2-5p facilitates esophageal squamous cell carcinoma cell proliferation and migration, Eur. Rev. Med. Pharmacol. Sci, 24 (2020) 6097-6110.

[78] X. Liu, Y. Cao, Y. Zhang, H. Zhou, H. Li, Regulatory effect of MiR103 on proliferation, EMT and invasion of oral squamous carcinoma cell through SALL4, Eur. Rev. Med. Pharmacol. Sci, 23 (2019) 9931-9938.

[79] Q. Wo, D. Zhang, L. Hu, J. Lyu, F. Xiang, W. Zheng, J. Shou, X. Qi, Long noncoding RNA SOX-2-OT facilitates prostate cancer cell proliferation and migration via miR-369-3p/CFL2 axis, Biochemical and biophysical research communications, 520 (2019) 586-593.

[80] X. Song, H. Wang, J. Wu, Y. Sun, Long Noncoding RNA SOX-2-OT Knockdown Inhibits Proliferation and Metastasis of Prostate Cancer Cells Through Modulating the miR-452-5p/HMGB3 Axis and Inactivating Wnt/β-Catenin Pathway, Cancer biotherapy & radiopharmaceuticals, 35 (2020) 682-695.

[81] E. D. Kwon, C. G. Drake, H. I. Scher, K. Fizazi, A. Bossi, A. J. Van den Eertwegh, M. Krainer, N. Houede, R. Santos, H. Mahammedi, Ipilimumab versus placebo after radiotherapy in patients with metastatic castration-resistant prostate cancer that had progressed after docetaxel chemotherapy (CA184-043): a multicentre, randomised, double-blind, phase 3 trial, The lancet oncology, 15 (2014) 700-712.

[82] T. Powles, K. C. Yuen, S. Gillessen, E. E. Kadel, D. Rathkopf, N. Matsubara, C. G. Drake, K. Fizazi, J. M. Piulats, P. J. Wysocki, Atezolizumab with enzalutamide versus enzalutamide alone in metastatic castration-resistant prostate cancer: a randomized phase 3 trial, Nature medicine, (2022) 1-10.

TABLE 2

| Symbol | fold.change_ND_vs_Con | fold.change_T2D_vs_Con | fold.change_T2D_vs_ND |
|---|---|---|---|
| MIR103A2 | -5.005253486 | 5.561461796 | 28.87518193 |
| ARL4AP5 | -1.95414835 | 11.57645127 | 22.58555682 |
| SOX2-OT | -3.67961811 | 6.016827533 | 21.86199733 |
| C7orf61 | -16.19318846 | 1.287780561 | 21.09214409 |
| FXYD7 | -15.97775953 | 1.194140851 | 18.89103921 |
| HRC | NA | 18.34802396 | 18.38664791 |
| MIR1286 | -6.042447073 | 3.004941052 | 17.62304769 |
| PIN1-DT | -11.61622709 | 1.505049851 | 17.27275791 |
| LINC01635 | -7.21885436 | 2.377951326 | 17.21696202 |
| EIF4BP9 | NA | 17.03338232 | 17.061045 |
| VN1R84P | -4.025192562 | 4.407524333 | 16.93310321 |
| MSANTD3-TMEFF1 | -5.467967563 | 3.093120737 | 16.84184086 |
| MIR4668 | -3.794992095 | 4.503584138 | 16.65817178 |
| SOAT2 | -7.145222742 | 2.327222179 | 16.58960244 |
| PMPCAP1 | -7.375271802 | 2.258772823 | 16.50219214 |
| ACOT6 | NA | 16.39857397 | 16.41723447 |
| RNFT1P3 | -1.95414835 | 8.433102195 | 16.41723447 |
| RPS15AP36 | -5.364217591 | 3.039649782 | 16.28294562 |
| PSG7 | -10.38224754 | 1.565430829 | 16.20783701 |
| ENPP7P4 | NA | 16.11715707 | 16.10324678 |
| OSTCP6 | -1.95414835 | 8.291342455 | 16.10324678 |
| RPS26P58 | NA | 15.28160126 | 15.31373522 |
| GAPDHP2 | NA | 14.63451474 | 14.66541845 |
| RNU6-1266P | -1.95414835 | 7.498300224 | 14.66541845 |
| RN7SL753P | NA | 14.51615745 | 14.53121252 |
| RPL23AP49 | NA | 14.51615745 | 14.53121252 |
| XACT | -5.364217591 | 2.699700996 | 14.53121252 |
| MIR6749 | NA | 14.34477297 | 14.37494052 |
| CCT7P1 | -5.251356856 | 2.689326562 | 14.29752482 |
| FEN1P1 | -7.145222742 | 1.969050084 | 14.08447622 |
| MTND4P9 | -9.048147608 | 1.554401104 | 14.0230489 |
| MIR6895 | NA | 13.81705101 | 13.81477337 |
| APOC1P1 | -7.039067573 | 1.94904635 | 13.72478559 |
| CRMP1 | -7.360603914 | 1.882017812 | 13.72478559 |
| NT5DC4 | -7.258223528 | 1.905266544 | 13.72478559 |
| ATP5POP1 | NA | 13.64889395 | 13.66175235 |
| DSCAS | -22.93864992 | -1.648352108 | 13.66175235 |
| SYS1-DBNDD2 | NA | 13.43514808 | 13.4236218 |
| ZSCAN5B | NA | 13.43514808 | 13.4236218 |
| MYCLP1 | -3.576580763 | 3.398912283 | 12.24346321 |
| ZFP3-DT | -3.338560543 | 3.581557246 | 12.24346321 |
| MIR320E | -5.343400469 | 2.224704053 | 12.01099843 |
| EVX1-AS | -3.576580763 | 3.305025103 | 11.90637711 |
| RN7SL673P | -1.95414835 | 6.051839571 | 11.83925105 |
| C6orf47-AS1 | -1.95414835 | 5.939793252 | 11.61391653 |
| EEF1A1P17 | NA | 11.58951773 | 11.61391653 |
| TNRC18P2 | NA | 11.51790377 | 11.5344449 |
| GCKR | 1.941286913 | 22.43553484 | 11.53390578 |
| CDH22 | -1.95414835 | 5.882701961 | 11.48067719 |
| LINC01191 | -1.95414835 | 5.88330687 | 11.48067719 |
| BOLA3P2 | NA | 11.24564302 | 11.2611859 |
| ASPG | -12.40052338 | -1.130515356 | 10.83595921 |
| AMD1P3 | -16.73045385 | -1.923512558 | 8.786012607 |
| EBLN1 | -9.710708538 | -1.139082694 | 8.433357667 |
| PON1 | -10.14244961 | -1.206643366 | 8.433357667 |
| YIPF7 | 1.941286913 | 15.28160126 | 7.835115047 |
| HNRNPA1P43 | 1.941286913 | 14.93286278 | 7.660002825 |
| LYPLA1P2 | 1.941286913 | 14.21937742 | 7.304044781 |
| TRAPPC12-AS1 | 1.941286913 | 14.21937742 | 7.304044781 |

TABLE 2-continued

| Symbol | fold.change_ND_vs_Con | fold.change_T2D_vs_Con | fold.change_T2D_vs_ND |
|---|---|---|---|
| SYT9 | −10.69818306 | −1.493394981 | 7.101129339 |
| RASL11B | 1.941286913 | 13.52581433 | 6.960067237 |
| RN7SL233P | 1.941286913 | 13.43514808 | 6.90919633 |
| MAP4K1-AS1 | 1.93779033 | 13.04484309 | 6.861066418 |
| KRT8P43 | 1.837761862 | 12.14129508 | 6.567584828 |
| MSLNL | 1.941286913 | 12.21772748 | 6.259597984 |
| NXF5 | 1.941286913 | 12.21772748 | 6.259597984 |
| SLC25A18 | −9.828509403 | −1.63357221 | 6.112170834 |
| TTLL7-IT1 | −10.08339379 | −1.667936375 | 6.112170834 |
| CALB1 | −10.83767733 | −1.88414567 | 5.804673018 |
| GOLGA6A | −12.16755032 | −2.12245189 | 5.804673018 |
| LINC02478 | −14.18711158 | −2.464381726 | 5.804673018 |
| ITFG2-AS1 | −18.40603109 | −3.224037325 | 5.738753 |
| LINC00514 | −18.09604507 | −3.17121297 | 5.738753 |
| LINC00839 | 3.532167601 | 19.90597601 | 5.566211957 |
| DHRS9 | −12.71429102 | −2.283182058 | 5.513617533 |
| NR1I3 | 3.359444518 | 19.0317079 | 5.5049762 |
| C8orf37-AS1 | −14.30238364 | −2.576952131 | 5.455394776 |
| IL34 | −15.97775953 | −2.877319162 | 5.455394776 |
| MEF2C-AS1 | −9.603789983 | −1.727468999 | 5.455394776 |
| PCNAP3 | −9.998729208 | −1.822776479 | 5.455394776 |
| S100A5 | −12.72644249 | −2.289749512 | 5.455394776 |
| NACAP2 | −16.39604187 | −2.983523671 | 5.376040403 |
| RPS2P35 | −10.8231515 | −1.968469606 | 5.376040403 |
| TFPI2-DT | −13.95942298 | −2.53758511 | 5.376040403 |
| TUBB7P | −16.50564813 | −2.991348858 | 5.376040403 |
| RNU6ATAC27P | 3.791983406 | 17.21142169 | 4.6031537 |
| RN7SL566P | 3.791983406 | 16.86150174 | 4.510505684 |
| MIR3188 | 3.741376995 | 16.34118817 | 4.432166905 |
| ST8SIA1 | −9.810908439 | −2.236021136 | 4.394075959 |
| PLA2G4D | −9.862996446 | −2.31895451 | 4.197116874 |
| SNORA2C | −12.79069411 | −2.993739578 | 4.196935597 |
| TACR2 | 5.470052118 | 22.31792376 | 4.091404515 |
| PPM1B-DT | 3.532167601 | 13.74537168 | 3.874795924 |
| RPS29P11 | 3.79556384 | 12.51549912 | 3.29540518 |
| DUTP5 | −10.08339379 | −3.306039019 | 3.040969275 |
| GREM2 | −11.1741458 | −3.663983679 | 3.040969275 |
| NCAN | −10.61115995 | −3.484869809 | 3.040969275 |
| TMEM151B | −14.07215785 | −4.617154809 | 3.040969275 |
| TOX | −13.18453787 | −4.323685583 | 3.040969275 |
| ZNF439 | −9.603789983 | −3.146949527 | 3.040969275 |
| LEF1-AS1 | 5.635914096 | 14.8730302 | 2.643906751 |
| MIR3942 | 5.591091016 | 14.553007 | 2.612937938 |
| PRB3 | 5.259436861 | 13.64889395 | 2.582360634 |
| RNU2-11P | 5.550542991 | 13.74537168 | 2.483664794 |
| KRTAP5-10 | 7.441317315 | 18.34802396 | 2.454771828 |
| ELANE | 7.531635955 | 18.34802396 | 2.430015001 |
| PSMC1P11 | 10.7288115 | 25.85980574 | 2.398148607 |
| METTL1P1 | 6.94078147 | 16.34118817 | 2.339064348 |
| TMEM178A | 8.389108217 | 16.50672602 | 1.946265873 |
| KRT18P24 | 7.401750341 | 13.88907825 | 1.881042995 |
| UVRAG-DT | 8.958595731 | 16.64672223 | 1.856433685 |
| FHAD1-AS1 | 14.38344291 | 25.30139478 | 1.756325906 |
| RNU4-82P | 6.895707273 | 12.21772748 | 1.743595235 |
| DRICH1 | −9.983897406 | −6.377333494 | 1.561316724 |
| LINC02273 | 14.79695992 | 19.67807114 | 1.334022351 |
| ADAM21P1 | 12.62327361 | 16.70293361 | 1.323803384 |
| YWHAQP6 | 14.89179559 | 16.75663828 | 1.129885801 |
| MTX1P1 | 12.94862208 | 14.51615745 | 1.11446628 |
| RSPH10B | 12.69723135 | 13.43514808 | 1.065830705 |
| ODAD2P1 | 14.01227818 | 14.21937742 | 1.006010808 |
| ANKH-DT | 12.41012118 | 11.88122465 | −1.057560665 |
| EXTL1 | 12.32880203 | 11.51790377 | −1.082425387 |
| KRTDAP | 13.12728448 | 11.82202401 | −1.119909098 |
| GAL3ST2 | −7.795498866 | −9.379773228 | −1.219461753 |
| LINC02450 | −10.84319839 | −13.46400157 | −1.247484692 |
| THAP12P3 | −7.500532301 | −9.343797493 | −1.247484692 |
| PCDHGA11 | 10.29376946 | 7.32344995 | −1.411400198 |
| NCCRP1 | 12.32880203 | 8.775667058 | −1.427497052 |
| SNORD121A | 16.82912387 | 10.99844258 | −1.523829498 |
| IGLV1-50 | 13.28994553 | 8.066997329 | −1.640721741 |
| PAPPA-AS1 | 16.48003044 | 9.156784442 | −1.851273062 |
| PFN1P11 | 16.39356435 | 8.548018223 | −1.927233361 |
| ZCRB1P1 | 9.488113901 | 4.519391044 | −2.128697818 |
| RNU4-5P | 12.32880203 | 5.792244848 | −2.15861817 |
| LINC01121 | −3.631523652 | −8.581952359 | −2.380969581 |
| SMAD5-AS1 | −3.983680008 | −9.351822884 | −2.380969581 |
| FAM90A2P | −4.303167361 | −10.11949762 | −2.409022859 |

TABLE 2-continued

| Symbol | fold.change_ND_vs_Con | fold.change_T2D_vs_Con | fold.change_T2D_vs_ND |
|---|---|---|---|
| RPSAP3 | −4.714392984 | −11.09303601 | −2.409022859 |
| RPL7AP60 | 14.79695992 | 5.501917716 | −2.662711594 |
| ERAS | 15.21143917 | 5.38052126 | −2.777039494 |
| GMFG | −3.277470518 | −10.92471505 | −3.222913366 |
| CASC19 | 10.06387269 | 3.03751863 | −3.318339706 |
| SLC39A5 | 10.06387269 | 3.03751863 | −3.318339706 |
| SCN3A | −3.197069026 | −11.04137182 | −3.486347121 |
| NOSTRIN | 10.64420431 | 3.03751863 | −3.513115191 |
| MIR3659HG | −2.63209785 | −9.194122085 | −3.515887642 |
| ZNF365 | −2.430730235 | −8.757645292 | −3.608425972 |
| RN7SL605P | 11.10145328 | 3.03751863 | −3.660794839 |
| INHBC | 11.88248381 | 3.108430533 | −3.954960211 |
| UBASH3A | 12.19592537 | 3.03751863 | −4.022401431 |
| ISLR2 | 12.27400704 | 3.03751863 | −4.050165488 |
| KRT18P3 | 12.491658 | 3.03751863 | −4.122092933 |
| SNORA68B | 12.78567296 | 3.03751863 | −4.216986982 |
| KRT18P18 | −2.299893975 | −10.56092913 | −4.566298419 |
| HNRNPH1P1 | −1.854577022 | −8.737087989 | −4.675693853 |
| MUC20P1 | −3.226844632 | −14.98418325 | −4.675693853 |
| SMYD3-IT1 | −1.919746307 | −9.071964133 | −4.766095576 |
| CICP14 | −2.156143973 | −10.19708749 | −4.820127561 |
| GUSBP17 | −1.587224712 | −8.749174049 | −5.495483533 |
| CCDC185 | −3.058191309 | −17.47777522 | −5.669375744 |
| SSTR2 | −1.565565318 | −8.947953204 | −5.730208872 |
| NTN5 | −2.092939914 | −12.10726294 | −5.787207683 |
| RNU6-1 | −1.888376929 | −11.02220952 | −5.812584626 |
| DUSP5-DT | −2.323326792 | −13.47776557 | −5.86548236 |
| HLA-DOA | −1.9777014 | −11.5557531 | −5.893228675 |
| OR2AG2 | −1.890209043 | −11.11931356 | −5.982977399 |
| ATXN7L3-AS1 | 18.16555157 | 3.03751863 | −5.99305182 |
| ACTG1P16 | −1.527078077 | −9.06057004 | −6.040926537 |
| EXOC3L1 | 9.428425544 | NA | −6.071659994 |
| RPS10P2 | 9.428425544 | NA | −6.071659994 |
| RN7SL75P | 10.06830058 | 1.559546761 | −6.466979376 |
| RAB25 | 10.42526375 | NA | −6.68612331 |
| RPL22P4 | 10.76020833 | NA | −6.914896158 |
| RN7SL663P | −1.294658636 | −9.06057004 | −7.083184173 |
| RPL37P1 | 11.01184317 | NA | −7.083184173 |
| TSSK3 | −1.932011554 | −13.55080123 | −7.111447117 |
| GPR88 | 11.10520311 | NA | −7.150691197 |
| RPL11P1 | 11.10520311 | NA | −7.150691197 |
| RPL7AP15 | 11.15715492 | NA | −7.178386137 |
| SLC6A15 | 11.15715492 | NA | −7.178386137 |
| RPL23AP81 | −1.643596918 | −11.70415839 | −7.203169246 |
| TMPRSS11D | 11.18639398 | NA | −7.203169246 |
| GNG8 | 11.27725201 | NA | −7.262285942 |
| RNU6-1062P | 11.38885747 | NA | −7.335147148 |
| RPL51P65 | −1.182425279 | −8.986309942 | −7.510875049 |
| CALCB | −1.184718929 | −9.282917726 | −7.800131787 |
| SETP6 | 12.37260804 | NA | −7.941528882 |
| LINC01277 | −1.770096398 | −14.21765816 | −8.105497114 |
| SPCS2P1 | 12.62327361 | NA | −8.10898234 |
| TPM3P6 | −1.356281155 | −11.17330924 | −8.162253747 |
| NDST1-AS1 | −1.344765413 | −10.87408353 | −8.219506411 |
| CCT6P4 | 12.77879724 | NA | −8.221175169 |
| ZMYND12 | −1.249339962 | −10.33818944 | −8.361184201 |
| PAK3 | 3.57138664 | −2.353788054 | −8.395057488 |
| GJD4 | 1.846270969 | −4.485708299 | −8.400479977 |
| SH3TC2-DT | 2.430482143 | −3.495319315 | −8.559286963 |
| RPL10P19 | 2.419344435 | −3.879914307 | −9.066446301 |
| DHX35-DT | −1.263100885 | −11.5557531 | −9.131799631 |
| RNU6-4P | 2.593768606 | −3.552055812 | −9.204909024 |
| AK5 | −1.084838923 | −9.890003709 | −9.241867375 |
| POC1B-GALNT4 | 7.406906609 | −1.248901844 | −9.269975236 |
| S1PR1 | 14.42690634 | NA | −9.269975236 |
| BMP3 | 14.45888151 | NA | −9.29635945 |
| LINC02086 | 1.200064627 | −7.607826418 | −9.298428203 |
| SNORD42B | 1.115534388 | −8.493655649 | −9.437199787 |
| MMP13 | 1.306451369 | −7.289472222 | −9.475068756 |
| ALDH8A1 | 1.195403699 | −7.99866325 | −9.518630381 |
| FNDC7 | 7.589768112 | −1.248901844 | −9.520429066 |
| NXPH2 | 1.664837723 | −5.633282003 | −9.520429066 |
| LINC01711 | 1.494652207 | −6.304932453 | −9.532751851 |
| RNU6-1263P | −1.088951774 | −10.2719814 | −9.55008141 |
| LINC02551 | −1.866949313 | −17.76312047 | −9.615943029 |
| LGALSL-DT | 1.393373391 | −6.839605235 | −9.623085508 |
| LINC01238 | 14.97796178 | NA | −9.645338599 |
| TBCEL-TECTA | −1.084765814 | −10.33818944 | −9.645338599 |

TABLE 2-continued

| Symbol | fold.change_ND_vs_Con | fold.change_T2D_vs_Con | fold.change_T2D_vs_ND |
|---|---|---|---|
| PCDHGB8P | 1.40822853 | −7.132656081 | −9.909038433 |
| MIXL1 | 1.010815775 | −9.894591466 | −10.04498935 |
| MAGED4B | 1.237974472 | −8.201607845 | −10.06786169 |
| CYP21A1P | 1.240807147 | −8.437943433 | −10.40516857 |
| HSPD1P12 | 1.88259871 | −5.402592792 | −10.43124127 |
| RNU6-126P | 4.46506153 | −2.353788054 | −10.43124127 |
| GFI1B | −1.22196946 | −12.83941581 | −10.54188293 |
| CHRNA4 | 2.970098586 | −3.642305209 | −10.65521794 |
| RN7SL130P | 4.803441744 | −2.209341304 | −10.92938747 |
| PDCL3P6 | 2.02015341 | −5.7745143 | −11.70572992 |
| FAM83E | 1.310501579 | −9.22803198 | −12.05848948 |
| RPL39P5 | −1.143100003 | −14.37748314 | −12.69993531 |
| GCM2 | 2.840365945 | −4.485708299 | −12.94997958 |
| LINC00167 | 1.103284269 | −11.70415839 | −12.95575494 |
| LINC01768 | 1.107680653 | −11.69702861 | −13.00610567 |
| HNRNPA1P27 | 10.6022635 | −1.248901844 | −13.31196668 |
| TEN1 | 3.093222345 | −4.3392147 | −13.8359405 |
| MIR579 | 4.159637865 | −3.350702681 | −14.21596734 |
| ZNF32-AS2 | 1.875726522 | −7.985547968 | −15.07910025 |
| RIPOR3 | 4.360920581 | −3.495319315 | −15.24592472 |
| C17orf64 | 6.600643215 | −2.353788054 | −15.44877987 |
| RAD21-AS1 | 2.336259348 | −6.923825947 | −16.24290064 |
| RNU6-9 | 2.439001599 | −7.132656081 | −17.23616482 |
| PSMC1P3 | 2.189027097 | −8.289942024 | −18.00760246 |
| PKN2-AS1 | 2.151501777 | −9.06057004 | −19.70123815 |
| LINC01473 | 5.777058261 | −3.350702681 | −19.8392474 |
| SNAP23P1 | 2.288636611 | −9.06057004 | −20.97327262 |

SEQUENCE LISTING (130 sequences)

SEQ ID NO: 1 - RNA, 72 nt, Homo sapiens
uacaucggccauuauaauacaaccugauaaguguuauagcacuuaucagauuguauuguaauugucugugua

SEQ ID NO: 2 - RNA, 23 nt, Homo sapiens
caaagugcuguucgugcagguag

SEQ ID NO: 3 - RNA, 22 nt, Homo sapiens
cacuagauugugagcuccugga

SEQ ID NO: 4 - RNA, 83 nt, Homo sapiens
cggggugagguaguagguugugugguuucagggcagugauguugccccucggaagauaacuauacaaccuacugccuucccug

SEQ ID NO: 5 - RNA, 64 nt, Homo sapiens
ccccgcgacgagccccucgcacaaaccggaccugagcguuuuguucguucggcucgcgugaggc

SEQ ID NO: 6 - RNA, 22 nt, Homo sapiens
cagcagcaauucauguuuugaa

SEQ ID NO: 7 - RNA, 95 nt, Homo sapiens
cucaucugucuguugggcuggaggcagggccuuugugaaggcggguggugcucagaucgccucugggcccuuccuccagccccgaggcggauuca

SEQ ID NO: 8 - RNA, 21 nt, Homo sapiens
uucacaguggcuaaguuccgc

SEQ ID NO: 9 - RNA, 22 nt, Homo sapiens
aaaagcuggguugagagggcaa

SEQ ID NO: 10 - RNA, 20 nt, Homo sapiens
aaaagcuggguugagagggu

SEQ ID NO: 11 - RNA, 19 nt, Homo sapiens
aaaagcuggguugagagga

SEQ ID NO: 12 - DNA, 2452 bp, Homo sapiens
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 13 - protein, 757 aa, Homo sapiens
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 14 - DNA, 1705 bp, Homo sapiens
attgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaa

SEQ ID NO: 15 - protein, 264 aa, Homo sapiens
MPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 16 - DNA, 1107 bp, Homo sapiens
aactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatttcttaaggtacaccaggatggagctggccatgactgctgagaagaagcacatgtccagatgataattcacgcacagttacaggttcccctccccaaagtggaacgtattattaataaaataatgttaaggagcagaaa

SEQ ID NO: 17 - DNA, 1630 bp, Homo sapiens
aactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaa

SEQ ID NO: 18 - protein, 202 aa, Homo sapiens
MMQDVSSSPVSPADDSLSNSEEEPDRQQPPSGKRGGRKRRSSRRSAGGGAGPGGAAGGGVGGGDEPGSPAQGKRGKKSAGCGGGGGAGGGGGSSSGGGSPQSYEELQTQRVMANVRERQRTQSLNEAFAALRKIIPTLPSDKLSKIQTLKLAARYIDFLYQVLQSDELDSKMASCSYVAHERLSYAFSVWRMEGAWSMSASH

SEQ ID NO: 19 - DNA, 2180 bp, Homo sapiens
agttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaatgaataatgcttattatgcatctgaagtgttattttatgtgttagattataataaagtaagctgctagtattattttta

SEQ ID NO: 20 - protein, 268 aa, Homo sapiens
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 21 - DNA, 2154 bp, Homo sapiens
gggaggcccacgtatggcgcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 22 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 23 - DNA, 1873 bp, Homo sapiens
cagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 24 - protein, 466 aa, Homo sapiens; identical to SEQ ID NO: 22

SEQ ID NO: 25 - DNA, 4628 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaa

SEQ ID NO: 26 - protein, 821 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 27 - DNA, 4878 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtttgtatggtacctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaa

SEQ ID NO: 28 - protein, 366 aa, Homo sapiens
MEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 29 - DNA, 4665 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacgttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaa

SEQ ID NO: 30 - protein, 227 aa, Homo sapiens
MALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 31 - DNA, 4811 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaa

SEQ ID NO: 32 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 33 - DNA, 6192 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 34 - protein, 1108 aa, Homo sapiens
MKVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 35 - DNA, 5874 bp, Homo sapiens
agacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacataaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 36 - protein, 1104 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDIKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 37 - DNA, 6189 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 38 - protein, 1107 aa, Homo sapiens
MKVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 39 - DNA, 5733 bp, Homo sapiens
agacacaagcgagaggatcatggcggatggccccaggtgtaagcgcagaaagcaggcgaacccgcggcgcaataacggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 40 - protein, 1057 aa, Homo sapiens
MADGPRCKRRKQANPRRNNGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 41 - DNA, 5937 bp, Homo sapiens
agacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 42 - protein, 1125 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 43 - DNA, 6706 bp, Homo sapiens
attccgctctactaaggaggctgctggcaagcggaacttctagcctctctttcaatccagctgaagttcaatctcattgaagtcacttcccatcccggttcgcttggggggaaaccaggcgtccctggaagggaagggaagggagtccgggctgcgcgggtcagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatgatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 44 - protein, 906 aa, Homo sapiens
MTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 45 - DNA, 6173 bp, Homo sapiens
agatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 46 - protein, 906 aa, Homo sapiens; identical to SEQ ID NO: 44

SEQ ID NO: 47 - DNA, 6475 bp, Homo sapiens
agatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 48 - protein, 906 aa, Homo sapiens; identical to SEQ ID NO: 44

SEQ ID NO: 49 - DNA, 6366 bp, Homo sapiens
attccgctctactaaggaggctgctggcaagcggaacttctagcctctctttcaatccagctgaagttcaatctcattgaagtcacttcccatcccggttcgcttggggggaaaccaggcgtccctggaagggaagggaagggagtccgggctgcgcgggtcagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccagggaaacacacacccctctgcctggcgtgagagttaaaaaaaaagagagacagcccgagggatcgagacctgaacatgtggtggtggttgcacagtcgccttttccagtttggagagacgttttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 50 - protein, 906 aa, Homo sapiens; identical to SEQ ID NO: 44

SEQ ID NO: 51 - DNA, 5972 bp, Homo sapiens
agatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 52 - protein, 906 aa, Homo sapiens; identical to SEQ ID NO: 44

SEQ ID NO: 53 - DNA, 6316 bp, Homo sapiens
agatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 54 - protein, 906 aa, Homo sapiens; identical to SEQ ID NO: 44

SEQ ID NO: 55 - DNA, 6554 bp, Homo sapiens
agatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 56 - protein, 906 aa, Homo sapiens; identical to SEQ ID NO: 44

SEQ ID NO: 57 - DNA, 6077 bp, Homo sapiens
agacacaagcgagaggatcatggcggatggccccaggtgtaagcgcagaaagcaggcgaacccgcggcgcaataacggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 58 - protein, 906 aa, Homo sapiens; identical to SEQ ID NO: 44

SEQ ID NO: 59 - DNA, 6017 bp, Homo sapiens
agacacaagcgagaggatcatggcggatggccccaggtgtaagcgcagaaagcaggcgaacccgcggcgcaataacggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacataaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 60 - protein, 906 aa, Homo sapiens; identical to SEQ ID NO: 44

SEQ ID NO: 61 - DNA, 6080 bp, Homo sapiens
agacacaagcgagaggatcatggcggatggccccaggtgtaagcgcagaaagcaggcgaacccgcggcgcaataacggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 62 - protein, 906 aa, Homo sapiens; identical to SEQ ID NO: 44

SEQ ID NO: 63 - DNA, 6312 bp, Homo sapiens
agacacaagcgagaggatcatggcggatggccccaggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 64 - protein, 906 aa, Homo sapiens; identical to SEQ ID NO: 44

SEQ ID NO: 65 - DNA, 5980 bp, Homo sapiens
agacacaagcgagaggatcatggcggatggccccaggtgtaagcgcagaaagcaggcgaacccgcggcgcaataacgctgtttaaggaagacagagcaggcattggataatattcttattaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 66 - protein, 906 aa, Homo sapiens; identical to SEQ ID NO: 44

SEQ ID NO: 67 - DNA, 6129 bp, Homo sapiens
agacacaagcgagaggatcatggcggatggccccaggtgtaagcgcagaaagcaggcgaacccgcggcgcaataacggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 68 - protein, 906 aa, Homo sapiens; identical to SEQ ID NO: 44

SEQ ID NO: 69 - DNA, 6236 bp, Homo sapiens
agacacaagcgagaggatcatggcggatggccccaggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 70 - protein, 906 aa, Homo sapiens; identical to SEQ ID NO: 44

SEQ ID NO: 71 - DNA, 6123 bp, Homo sapiens
agacacaagcgagaggatcatggcggatggccccaggtgtaagcgcagaaagcaggcgaacccgcggcgcaataacgctgtttaaggaagacagagcaggcattggataatattcttattaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 72 - protein, 906 aa, Homo sapiens; identical to SEQ ID NO: 44

SEQ ID NO: 73 - DNA, 6233 bp, Homo sapiens
agacacaagcgagaggatcatggcggatggccccaggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 74 - protein, 906 aa, Homo sapiens; identical to SEQ ID NO: 44

SEQ ID NO: 75 - DNA, 6297 bp, Homo sapiens
gcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 76 - protein, 906 aa, Homo sapiens; identical to SEQ ID NO: 44

SEQ ID NO: 77 - DNA, 6300 bp, Homo sapiens
gcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 78 - protein, 906 aa, Homo sapiens; identical to SEQ ID NO: 44

SEQ ID NO: 79 - DNA, 6139 bp, Homo sapiens
gcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaagcagctgtttaaggaagacagagcaggcattggataatattcttattaaggaaaggaagggcaagaaatcctggggcctgaagctcaggcagatgaagcaggatgtacagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 80 - protein, 906 aa, Homo sapiens; identical to SEQ ID NO: 44

SEQ ID NO: 81 - DNA, 6005 bp, Homo sapiens
attgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 82 - protein, 906 aa, Homo sapiens; identical to SEQ ID NO: 44

SEQ ID NO: 83 - DNA, 6002 bp, Homo sapiens
attgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 84 - protein, 906 aa, Homo sapiens; identical to SEQ ID NO: 44

SEQ ID NO: 85 - DNA, 6148 bp, Homo sapiens
attgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttgacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 86 - protein, 906 aa, Homo sapiens; identical to SEQ ID NO: 44

SEQ ID NO: 87 - DNA, 6491 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 88 - protein, 906 aa, Homo sapiens; identical to SEQ ID NO: 44

SEQ ID NO: 89 - DNA, 6430 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagctgtttaaggaagacagagcaggcattggataatattcttattaaggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 90 - protein, 906 aa, Homo sapiens; identical to SEQ ID NO: 44

SEQ ID NO: 91 - DNA, 6414 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 92 - protein, 906 aa, Homo sapiens; identical to SEQ ID NO: 44

SEQ ID NO: 93 - DNA, 6332 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 94 - protein, 906 aa, Homo sapiens; identical to SEQ ID NO: 44

SEQ ID NO: 95 - DNA, 6272 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacataaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 96 - protein, 906 aa, Homo sapiens; identical to SEQ ID NO: 44

SEQ ID NO: 97 - DNA, 6195 bp, Homo sapiens
gcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 98 - protein, 906 aa, Homo sapiens; identical to SEQ ID NO: 44

SEQ ID NO: 99 - DNA, 6247 bp, Homo sapiens
gcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcaggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 100 - protein, 906 aa, Homo sapiens; identical to SEQ ID NO: 44

SEQ ID NO: 101 - DNA, 6192 bp, Homo sapiens
gcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 102 - protein, 906 aa, Homo sapiens; identical to SEQ ID NO: 44

SEQ ID NO: 103 - DNA, 5712 bp, Homo sapiens
agacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 104 - protein, 1050 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDRTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 105 - DNA, 5827 bp, Homo sapiens
gcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 106 - protein, 1036 aa, Homo sapiens
MATCAVTNYNTVVETNSDSDDEDKLHIVEEESVTDAADCEGVPEDDLPTDQTVLPGRSSEREGNAKNCWEDDRTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 107 - DNA, 6052 bp, Homo sapiens
gcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 108 - protein, 1111 aa, Homo sapiens
MATCAVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 109 - DNA, 6049 bp, Homo sapiens
gcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 110 - protein, 1110 aa, Homo sapiens
MATCAVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 111 - DNA, 5967 bp, Homo sapiens
gtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 112 - protein, 1033 aa, Homo sapiens
MKVTNYNTVVETNSDSDDEDKLHIVEEESVTDAADCEGVPEDDLPTDQTVLPGRSSEREGNAKNCWEDDRTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 113 - DNA, 5934 bp, Homo sapiens
agacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttc

SEQ ID NO: 114 - protein, 1124 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 115 - DNA, 5814 bp, Homo sapiens
gaggtgactcgagcatttagacacaagcgagaggatcatggcggatggccccaggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatgatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaa

SEQ ID NO: 116 - protein, 906 aa, Homo sapiens; identical to SEQ ID NO: 44

SEQ ID NO: 117 - DNA, 5716 bp, Homo sapiens
tttagacacaagcgagaggatcatggcggatggccccaggtgtaagcgcagaaagcaggcgaacccgcggcgcaataacgttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagggaaagcccctcaaaccattttgtattctgtattacacttcagaaagtgtggaagcaaaggtcatctaatctttaaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaa

SEQ ID NO: 118 - protein, 906 aa, Homo sapiens; identical to SEQ ID NO: 44

SEQ ID NO: 119 - DNA, 6117 bp, Homo sapiens
tttctccctcccctctgggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatgatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacacaggaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaa

SEQ ID NO: 120 - protein, 906 aa, Homo sapiens; identical to SEQ ID NO: 44

SEQ ID NO: 121 - DNA, 18697 bp, Homo sapiens
agagcctggcccggcgccagcagcctgaggaatgtggtggttggagccggtgactaattcaaaccagaactcagggaggagtggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttga

SEQ ID NO: 122 - protein, 5890 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLGETQSRTITVTRRVTAYTVDVTGREGAKDIDISSPEFKIKIPRHELTEISNVDVETQSGKTVIRLPSGSGAASPTGSAVDIRAGAISASGPELQGAGHSKLQVTMPGIKVGGSGVNVNAKGLDLGGRGGVQVPAVDISSSLGGRAVEVQGPSLESGDHGKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVVVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLPKADIDVSGPSVDTDAPDLDIEGPEGKLKGSKFKMPKLNIKAPKVSMPDVDLNLKGPKLKGEIDASVPELEGDLRGPQVDVKGPFVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGPKVKGDVDISLPKVEGDLKGPEVDIRGPQVDIDVPDVGVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMKVPDVDIKGPKVDINAPDVDVQGPDWHLKMPKIKMPKISMPGFKGEGPEVDVNLPKADLDVSGPKVDVDVPDVNIEGPDAKLKGPKFKMPEMNIKAPKISMPDLDLNLKGPKMKGEVDVSLANVEGDLKGPALDIKGPKIDVDAPDIDIHGPDAKLKGPKLKMPDMHVNMPKISMPEIDLNLKGSKLKGDVDVSGPKLEGDIKAPSLDIKGPEVDVSGPKLNIEGKSKKSRFKLPKFNFSGSKVQTPEVDVKGKKPDIDITGPKVDINAPDVEVQGKVKGSKFKMPFLSISSPKVSMPDVELNLKSPKVKGDLDIAGPNLEGDFKGPKVDIKAPEVNLNAPDVDVHGPDWNLKMPKMKMPKFSVSGLKAEGPDVAVDLPKGDINIEGPSMNIEGPDLNVEGPEGGLKGPKFKMPDMNIKAPKISMPDIDLNLKGPKVKGDVDISLPKLEGDLKGPEVDIKGPKVDINAPDVDVHGPDWHLKMPKVKMPKFSMPGFKGEGPEVDVTLPKADIDISGPNVDVDVPDVNIEGPDAKLKGPKFKMPEMNIKAPKISMPDFDLNLKGPKMKGDVVVSLPKVEGDLKGPEVDIKGPKVDIDTPDINIEGSEGKFKGPKFKIPEMHLKAPKISMPDIDLNLKGPKVKGDVDVSLPKMEGDLKGPEVDIKGPKVDINAPDVDVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMQVPDLDIKGPKVDINAPDVDVRGPDWHLKMPKIKMPKISMPGFKGEGPEVDVNLPKADLDVSGPKVDVDVPDVNIEGPDAKLKGPKFKMPEMNIKAPKISMPDFDLHLKGPKVKGDVDVSLPKMEGDLKAPEVDIKGPKVDIDAPDVDVHGPDWHLKMPKVKMPKFSMPGFKGEGPEVDVNLPKADIDVSGPKVDIDTPDIDIHGPEGKLKGPKFKMPDLHLKAPKISMPEVDLNLKGPKMKGDVDVSLPKVEGDLKGPEVDIKGPKVDIDVPDVDVQGPDWHLKMPKVKMPKFSMPGFKGEGPDVDVNLPKADLDVSGPKVDIDVPDVNIEGPDAKLKGPKFKMPEMNIKAPKISMPDFDLHLKGPKVKGDVDVSLPKVEGDLKGPEVDIKGPKVDIDAPDVDVHGPDWHLKMPKVKMPKFSMPGFKGEGPDVDVTLPKADIEISGPKVDIDAPDVSIEGPDAKLKGPKFKMPEMNIKAPKISMPDIDFNLKGPKVKGDVDVSLPKVEGDLKGPEIDIKGPSLDIDTPDVNIEGPEGKLKGPKFKMPEMNIKAPKISMPDFDLHLKGPKVKGDVDVSLPKVESDLKGPEVDIEGPEGKLKGPKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGPEVDIRDPKVDIDVPDVDVQGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDAKLKGPKFKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGAKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 123 - DNA, 18713 bp, Homo sapiens
aagctgcgctcgctggaaccctgcgctccagcggtgcgcgccaggagagggggcccgaagcgaggtctcgcctagagttggaaaggcagcgtgcttagggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttga

SEQ ID NO: 124 - protein, 5890 aa, Homo sapiens; identical to SEQ ID NO: 122

SEQ ID NO: 125 - DNA, 18761 bp, Homo sapiens
ggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttga

SEQ ID NO: 126 - protein, 5890 aa, Homo sapiens; identical to SEQ ID NO: 122

SEQ ID NO: 127 - DNA, 1036 bp, Homo sapiens
ggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagcatc

SEQ ID NO: 128 - protein, 149 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 129 - DNA, 18556 bp, Homo sapiens
actcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttga

SEQ ID NO: 130 - protein, 5823 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLGETQSRTITVTRRVTAYTVDVTGREGAKDIDISSPEFKIKIPRHELTEISNVDVETQSGKTVIRLPSGSGAASPTGSAVDIRAGAISASGPELQGAGHSKLQVTMPGIKVGGSGVNVNAKGLDLGGRGGVQVPAVDISSSLGGRAVEVQGPSLESGDHGKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVVVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLPKADIDVSGPSVDTDAPDLDIEGPEGKLKGSKFKMPKLNIKAPKVSMPDVDLNLKGPKLKGEIDASVPELEGDLRGPQVDVKGPFVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLHLKGPKVKGDVDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGPKVKGDVDISLPKVEGDLKGPEVDIRGPQVDIDVPDVGVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMKVPDVDIKGPKVDINAPDVDVQGPDWHLKMPKIKMPKISMPGFKGEGPEVDVNLPKADLDVSGPKVDVDVPDVNIEGPDAKLKGPKFKMPEMNIKAPKISMPDLDLNLKGPKMKGEVDVSLANVEGDLKGPALDIKGPKIDVDAPDIDIHGPDAKLKGPKLKMPDMHVNMPKISMPEIDLNLKGSKLKGDVDVSGPKLEGDIKAPSLDIKGPEVDVSGPKLNIEGKSKKSRFKLPKFNFSGSKVQTPEVDVKGKKPDIDITGPKVDINAPDVEVQGKVKGSKFKMPFLSISSPKVSMPDVELNLKSPKVKGDLDIAGPNLEGDFKGPKVDIKAPEVNLNAPDVDVHGPDWNLKMPKMKMPKFSVSGLKAEGPDVAVDLPKGDINIEGPSMNIEGPDLNVEGPEGGLKGPKFKMPDMNIKAPKISMPDIDLNLKGPKVKGDVDISLPKLEGDLKGPEVDIKGPKVDINAPDVDVHGPDWHLKMPKVKMPKFSMPGFKGEGPEVDVTLPKADIDISGPNVDVDVPDVNIEGPDAKLKGPKFKMPEMNIKAPKISMPDFDLNLKGPKMKGDVVVSLPKVEGDLKGPEVDIKGPKVDIDTPDINIEGSEGKFKGPKFKIPEMHLKAPKISMPDIDLNLKGPKVKGDVDVSLPKMEGDLKGPEVDIKGPKVDINAPDVDVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMQVPDLDIKGPKVDINAPDVDVRGPDWHLKMPKIKMPKISMPGFKGEGPEVDVNLPKADLDVSGPKVDVDVPDVNIEGPDAKLKGPKFKMPEMNIKAPKISMPDFDLHLKGPKVKGDVDVSLPKMEGDLKAPEVDIKGPKVDIDAPDVDVHGPDWHLKMPKVKMPKFSMPGFKGEGPEVDVNLPKADIDVSGPKVDIDTPDIDIHGPEGKLKGPKFKMPDLHLKAPKISMPEVDLNLKGPKMKGDVDVSLPKVEGDLKGPEVDIKGPKVDIDVPDVDVQGPDWHLKMPKVKMPKFSMPGFKGEGPDVDVNLPKADLDVSGPKVDIDVPDVNIEGPDAKLKGPKFKMPEMNIKAPKISMPDFDLHLKGPKVKGDVDVSLPKVEGDLKGPEVDIKGPKVDIDAPDVDVHGPDWHLKMPKVKMPKFSMPGFKGEGPDVDVTLPKADIEISGPKVDIDAPDVSIEGPDAKLKGPKFKMPEMNIKAPKISMPDIDFNLKGPKVKGDVDVSLPKVEGDLKGPEIDIKGPSLDIDTPDVNIEGPEGKLKGPKFKMPEMNIKAPKISMPDFDLHLKGPKVKGDVDVSLPKVESDLKGPEVDIEGPEGKLKGPKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGPEVDIRDPKVDIDVPDVDVQGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDAKLKGPKFKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGAKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

What is claimed herein is:

1. A method of treating an overweight, obese or diabetic subject with cancer, the method comprising administering
   (i) a glucose-controlling medication, or obesity medication and/or
   (ii) CT scans at a frequency of higher than one CT scan every 6 months to an overweight, obese or diabetic subject with cancer determined to have
      (a) an expression level of at least one gene selected from: miR374a-5p, miR-93-5p, miR-28-3p, miR-let-7b-3p, TSP5, SNAI1, TWIST1, SNAI2, vimentin (VIM), ZEB1 and AHNAK in an exosome originating from the adipose tissue or adipocytes of the subject, wherein the expression level of the at least one gene is increased relative to a reference; or
      (b) an expression level of at least one gene selected from: miR424-5p, miR-326, miR-27a-3p, miR320b and miR320d in an exosome originating from the adipose tissue or adipocytes of the subject, wherein the expression level of the at least one gene is decreased relative to a reference.

2. The method of claim 1, wherein the glucose-controlling medication is selected from the group consisting of: metformin, a sulfonylurea, a glinide, a SGLT2 inhibitor, and insulin; or the obesity medication selected from the group consisting of:
   orlistat, phentermine-topiramate, naltrexone-bupropion, liraglutide, semagludtide, setmelanotide, phentermine, benzphetamine, diethylpropion, and phendimetrazine.

3. The method of claim 1, wherein the cancer is an epithelial adenocarcinoma, esophageal cancer, pancreatic cancer, cervical cancer, colorectal cancer, gastric cancer, lung cancer, uterine cancer, renal cancer, breast cancer, or prostate cancer.

4. The method of claim 1, wherein the cancer is an epithelial cancer.

5. The method of claim 1, wherein the overweight, obese, or diabetic subject with cancer is administered a glucose-controlling medication or obesity medication.

6. A method of treating an overweight, obese or diabetic subject with cancer, the method comprising administering at least one CT scan to an overweight, obese or diabetic subject with cancer determined to have
   (a) an expression level of at least one gene selected from: miR374a-5p, miR-93-5p, miR-28-3p, miR-let-7b-3p, TSP5, SNAI1, TWIST1, SNAI2, vimentin (VIM), E-cadherin (CDH1), ZEB1 and AHNAK in an exosome originating from the adipose tissue or adipocytes of the subject, wherein the expression level of the at least one gene is not increased relative to a reference; or (b) an expression level of at least one gene selected from: miR424-5p, miR-326, miR-27a-3p, miR320b and miR320d in an exosome originating from the adipose tissue or adipocytes of the subject, wherein the expression level of the at least one gene is not decreased relative to a reference, wherein the at least one CT scan is administered at a frequency of no more than one CT scan every six months.

7. A method comprising:

determining the expression of at least one gene selected from the group consisting of:

miR374a-5p, miR-93-5p, miR-28-3p, miR-let-7b-3p, miR-375, TSP5, Snail Family Transcriptional Repressor 1 (SNAI1), Twist Family bHLH Transcription Factor 1 (TWIST1), Snail Family Transcriptional Repressor 2 (SNAI2), vimentin (VIM), ZEB1, AHNAK, miR-424-5p, miR-326, miR-27a-3p, miR320b, and miR320d;

in an exosome obtained from a subject;

wherein the expression of at least four genes selected from the group consisting of:

miR374a-5p, miR-93-5p, miR-28-3p, miR-let-7b-3p, and miR-375;

is determined.

8. The method of claim 7, wherein the expression of at least miR374a-5p, miR-93-5p, miR-28-3p, miR-let-7b-3p, and miR-375; is determined.

9. The method of claim 7, wherein one of the at least four genes is miR374a-5p.

10. The method of claim 7, wherein the level of expression is the level of mRNA.

11. The method of claim 7, wherein the exosome originates from or is isolated from a non-tumor tissue or cells.

12. The method of claim 11, wherein the non-tumor tissue or cells is blood, plasma, adipose tissue, adipocytes, or bone.

13. The method of claim 7, wherein the exosome originates from adipose tissue or adipocytes.

14. The method of claim 7, wherein the exosome is 35-150 nm in diameter and originates from adipose tissue or adipocytes.

15. A method comprising:

determining the expression of at least one gene selected from the group consisting of:

miR374a-5p, miR-93-5p, miR-28-3p, miR-let-7b-3p, miR-375, TSP5, Snail Family Transcriptional Repressor 1 (SNAI1), Twist Family bHLH Transcription Factor 1 (TWIST1), Snail Family Transcriptional Repressor 2 (SNAI2), vimentin (VIM), ZEB1, AHNAK, miR-424-5p, miR-326, miR-27a-3p, miR320b, and miR320d;

in an exosome obtained from a subject;

wherein the exosome originates from adipose tissue or adipocytes.

16. The method of claim 15, wherein the expression of at least one gene selected from the group consisting of:

miR374a-5p, miR-93-5p, miR-28-3p, miR-let-7b-3p, miR-375, miR-424-5p, miR-326, miR-27a-3p, miR320b, and miR320d;

is determined.

17. The method of claim 15, wherein the expression of at least one gene selected from the group consisting of:

miR374a-5p, miR-93-5p, miR-28-3p, miR-let-7b-3p, and miR-375;

is determined.

18. The method of claim 15, wherein the expression of at least two genes selected from the group consisting of:

miR374a-5p, miR-93-5p, miR-28-3p, miR-let-7b-3p, and miR-375;

is determined.

19. The method of claim 15, wherein the expression of at least three genes selected from the group consisting of:

miR374a-5p, miR-93-5p, miR-28-3p, miR-let-7b-3p, and miR-375;

is determined.

20. The method of claim 15, wherein the expression of at least four genes selected from the group consisting of:

miR374a-5p, miR-93-5p, miR-28-3p, miR-let-7b-3p, and miR-375;

is determined.

21. The method of claim 15, wherein the expression of at least miR374a-5p, miR-93-5p, miR-28-3p, miR-let-7b-3p, and miR-375; is determined.

22. The method of claim 15, wherein the expression of at least miR374a-5p is determined.

23. The method of claim 15, wherein the level of expression is the level of mRNA.

24. The method of claim 15, wherein the exosome is 35-150 nm in diameter and originates from adipose tissue or adipocytes.

\* \* \* \* \*